(12) United States Patent
Meder et al.

(10) Patent No.: US 9,938,580 B2
(45) Date of Patent: Apr. 10, 2018

(54) EPIGENETIC SIGNATURES AS MARKER FOR CARDIOMYOPATHIES AND MYOCARDIAL INSUFFICIENCIES

(71) Applicant: RUPRECHT-KARLS-UNIVERSITÄT HEIDELBERG, Heidelberg (DE)

(72) Inventors: Benjamin Meder, Dossenheim (DE); Jan Haas, Walldorf (DE); Hugo A. Katus, Heidelberg (DE)

(73) Assignee: RUPRECHT-KARLS-UNIVERSITÄT HEIDELBERG, Heidelberg (DE)

( * ) Notice: Subject to any disclaimer, the term of this patent is extended or adjusted under 35 U.S.C. 154(b) by 0 days.

(21) Appl. No.: 14/384,955

(22) PCT Filed: Mar. 14, 2013

(86) PCT No.: PCT/EP2013/055267
§ 371 (c)(1),
(2) Date: Sep. 12, 2014

(87) PCT Pub. No.: WO2013/135830
PCT Pub. Date: Sep. 19, 2013

(65) Prior Publication Data
US 2015/0065355 A1    Mar. 5, 2015

Related U.S. Application Data

(60) Provisional application No. 61/610,841, filed on Mar. 14, 2012.

(51) Int. Cl.
*C12Q 1/68* (2006.01)
*C12P 19/34* (2006.01)
*C07H 21/02* (2006.01)

(52) U.S. Cl.
CPC ..... *C12Q 1/6883* (2013.01); *C12Q 2600/106* (2013.01); *C12Q 2600/112* (2013.01); *C12Q 2600/118* (2013.01); *C12Q 2600/154* (2013.01)

(58) Field of Classification Search
CPC ............ C12Q 1/6883; C12Q 2600/112; C12Q 2600/118; C12Q 2600/154
See application file for complete search history.

(56) References Cited

FOREIGN PATENT DOCUMENTS

WO    WO 02/00932 A2    1/2002

OTHER PUBLICATIONS

Movassagh M. et al. Epigenomics (Feb. 2011) 3(1), 103-109.*
Costello J.F. et al. (1994) The Journal of Biological Chemistry, 269,17228-17237.*
Chen, G. et al. Molecular & Cellular Proteomics 1.4 (2002) pp. 304-313.*
Cheung V.G. et al. Nature Genetics (Mar. 2003) vol. 33, pp. 422-425.*
Baccarelli, Andrea et al., "Ischemic heart disease and stroke relation to blood DNA methylation," *Epidemiology*, 2010, 21(6):819-828.
Buria, Sandra et al., "DNA methylation and Yin Yang-1 repress adenosine $A_{2A}$ receptor levels in human brain," *Journal of Neurochemistry*, 2010, 115(1):283-295.
Haas, Jan et al., "Alterations in Cardiac DNA methylation in human dilated cardiomyopathy," *EMBO Molecular Medicine*, 2013, 5(3):413-429.
Movassagh, Mehregan etal., "Differential DNA Methylation Correlates with Differential Expression of Angiogenic Factors in Human Heart Failure," *PLoS One*, 2010, 5(1):e8564.
Post, Wendy S. et al. "Methylation of the estrogen receptor gene is associated with aging and atherosclerosis in the cardiovascular system," *Cardiovascular Research*, 1999, 43(4):985-991.
Umeda, Patrick K. et al., "Epigenetic alterations in diabetic cardiomyopathy," *Progress in Experimental Cardiology*, 2001, 33(6):1.

* cited by examiner

*Primary Examiner* — Stephen T Kapushoc
(74) *Attorney, Agent, or Firm* — Saliwanchik, Lloyd & Eisenschenk

(57) ABSTRACT

The present invention relates to the use of DNA methylation profiles of patient samples for the diagnosis, prognosis and/or therapy monitoring of a heart disease in a patient, wherein the DNA methylation profile of the patient sample is compared with the DNA methylation profile of a control sample, and wherein a difference in the DNA methylation profile of the patient sample compared to the control sample is indicative of a heart disease or of the risk for developing a heart disease or for a prediction of therapy effects or therapy outcome. The present invention further relates to methods for the diagnosis, prognosis and/or therapy monitoring of a heart disease in a patient, comprising determining the DNA methylation profile in a patient sample comprising genomic DNA from heart cells, heart tissue or peripheral blood; and comparing the DNA methylation profile in the patient sample with the DNA methylation profile from a normal subject not having a heart disease or having a normal heart function. The present invention furthermore relates to kits that are suitable for the methods and uses of the invention. The present invention furthermore relates to the use of ADORA2A, ERBB3, LY75, HOXB13, GF11, CLDN4, FDX1, ID4, NAT1, PPARGC1A, SULF2, TFF1, TKT, ATP2C, CCDC59, GSTM5m, SLC9A6 and TDG as marker for the diagnosis, prognosis and/or therapy monitoring of a heart disease in a patient.

12 Claims, 16 Drawing Sheets

Figure 1 A and B
A
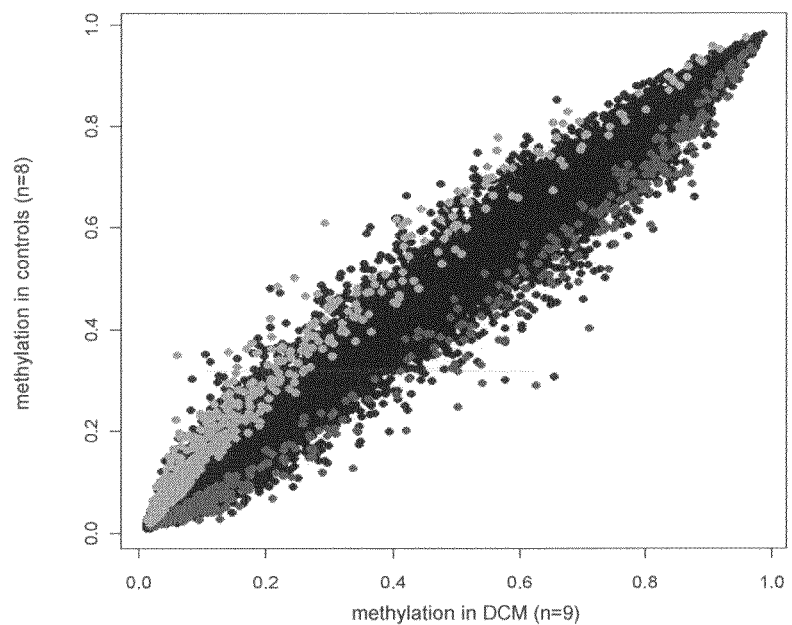
B
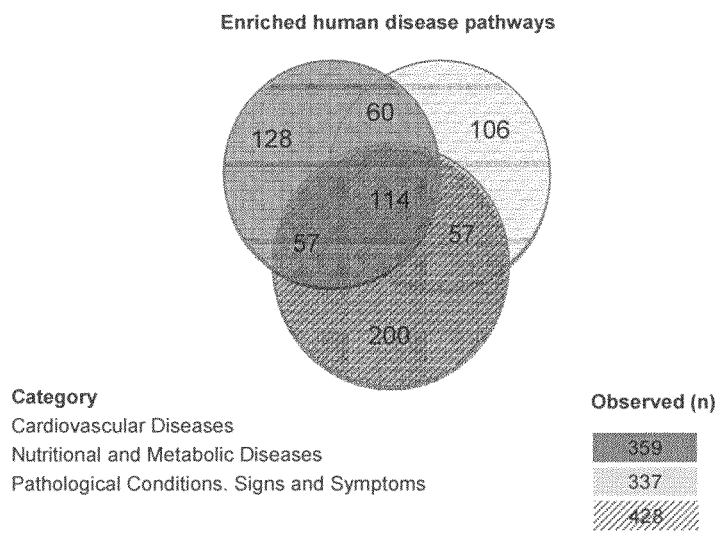

Figure 3 A and B
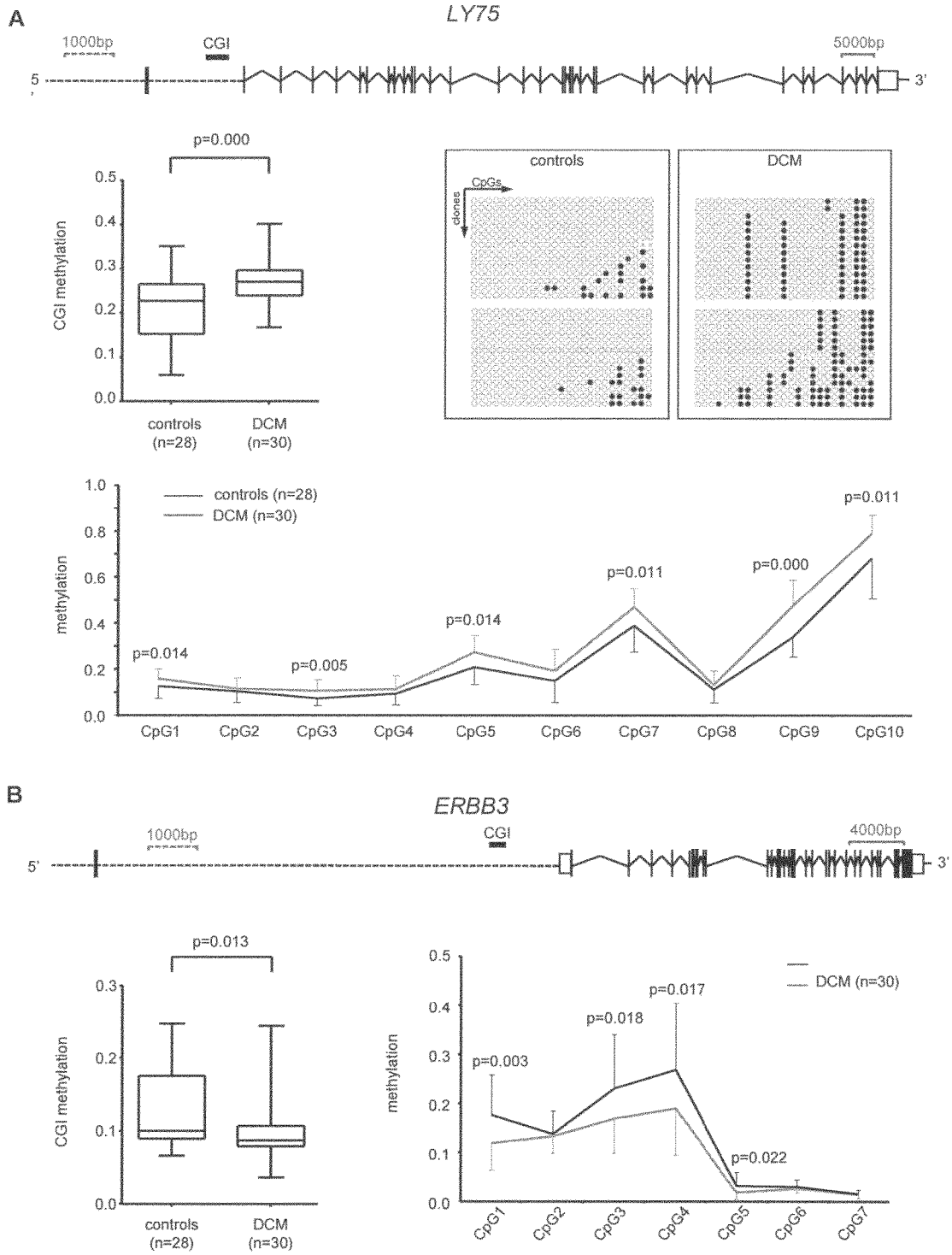

Figure 3 C and D
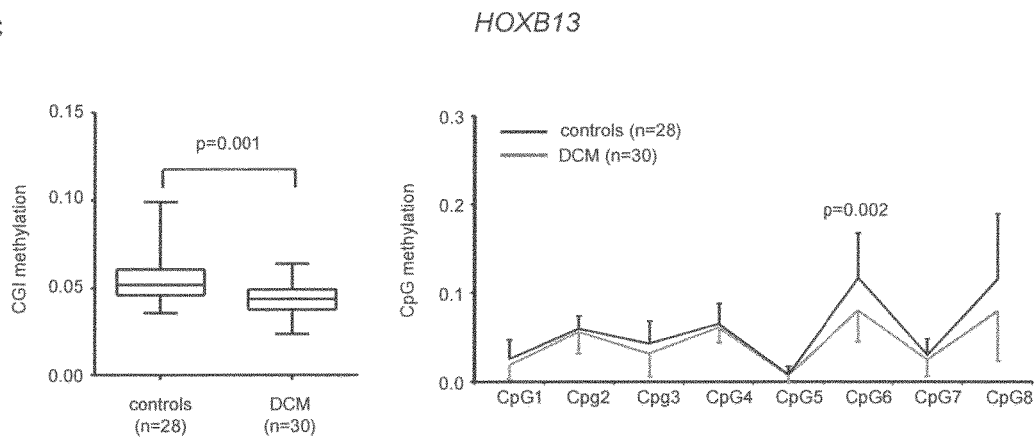
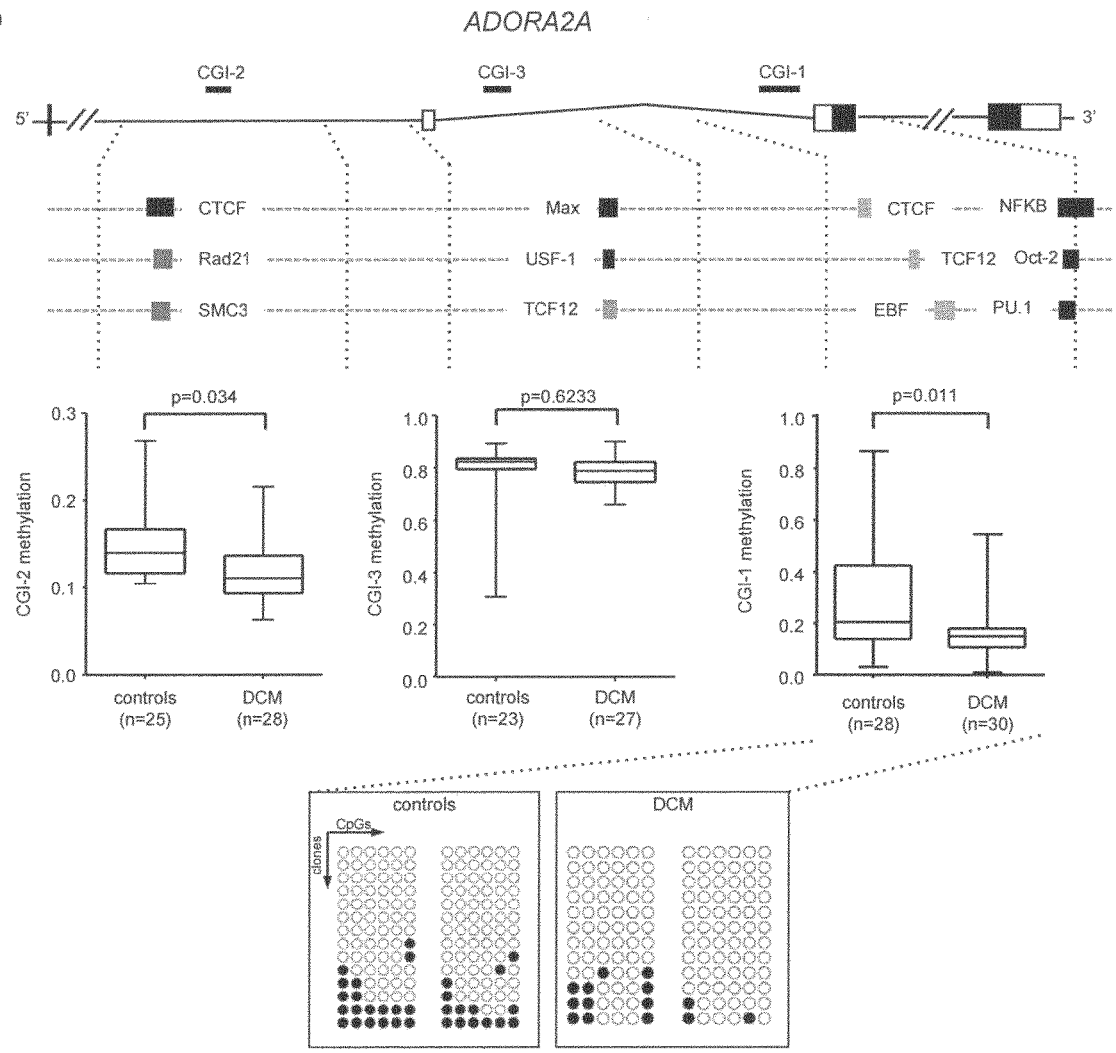

Figure 4 A-F
A
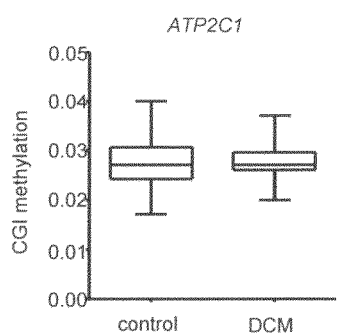
B
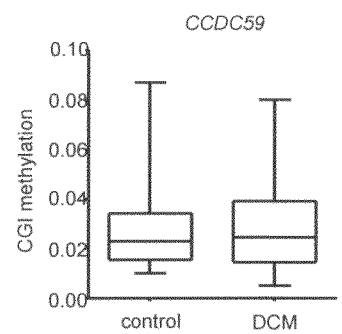
C
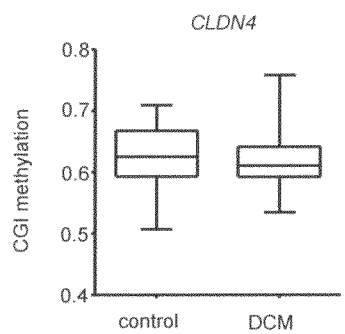
D
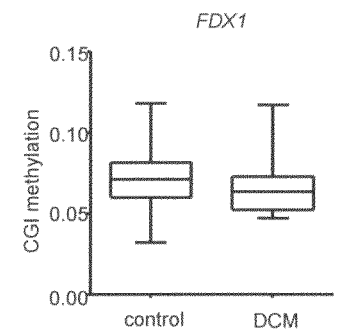
E
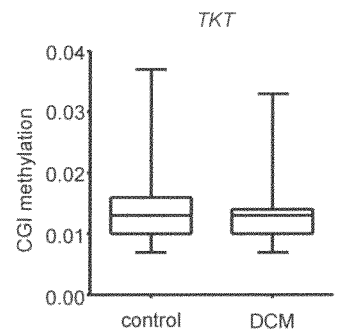
F
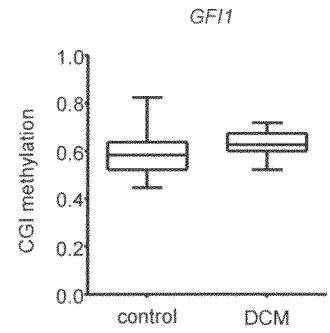

Figure 4 G-L
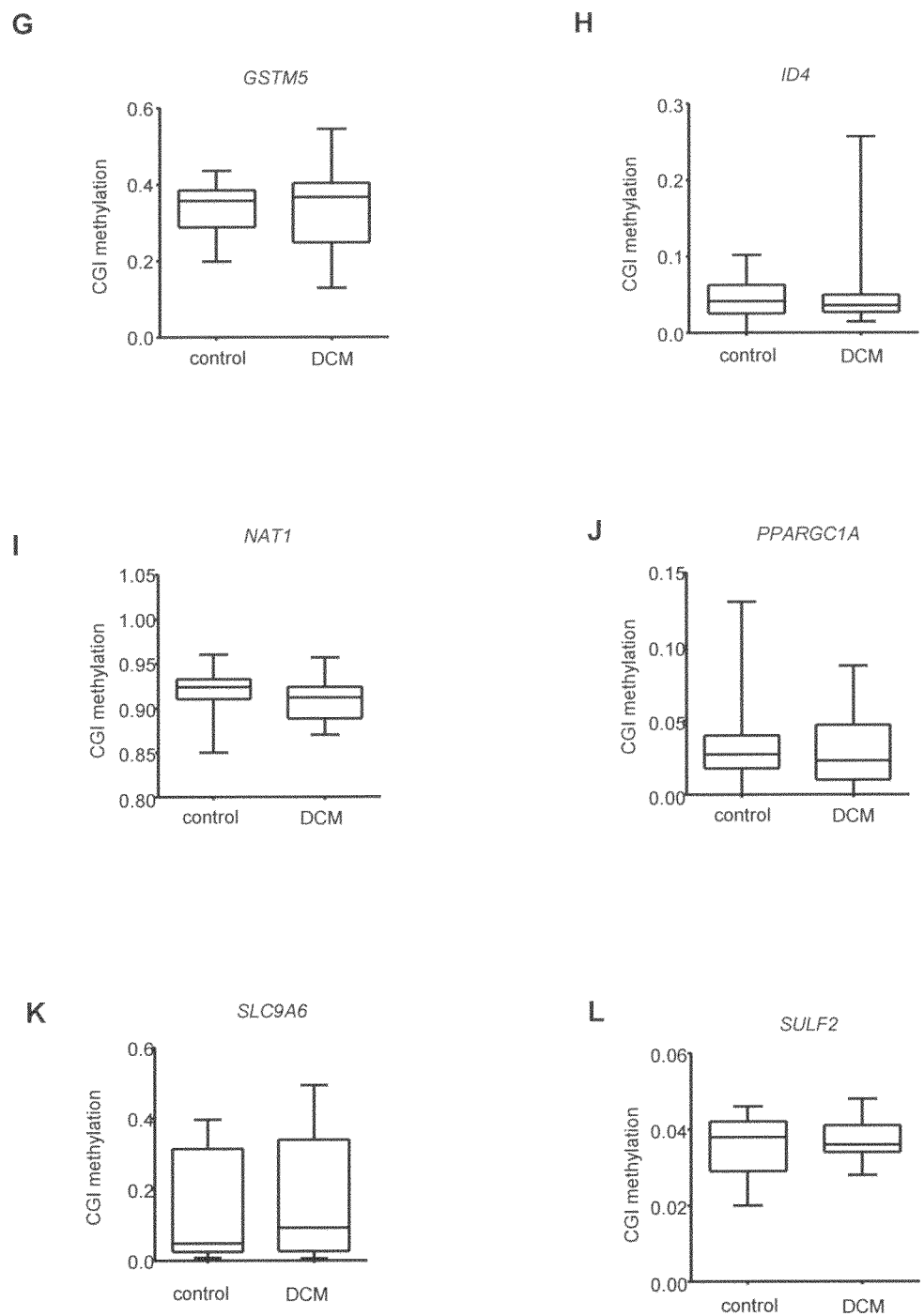

Figure 4 M-P
M
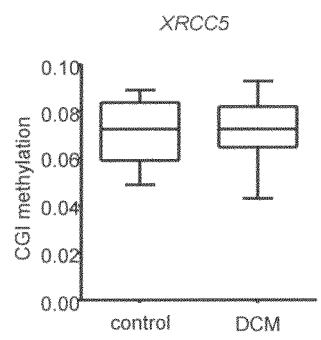
N
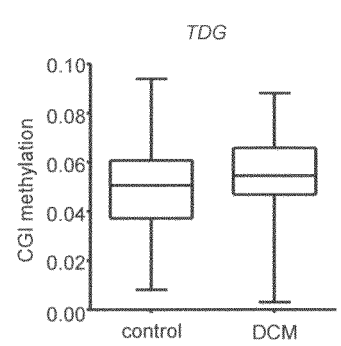
O
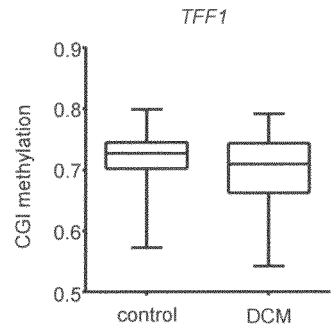
P
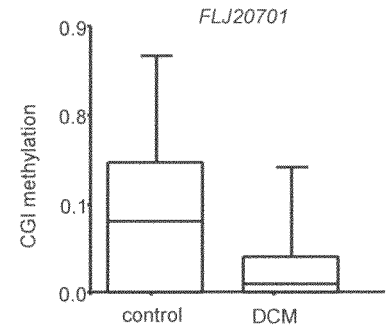

Figure 6
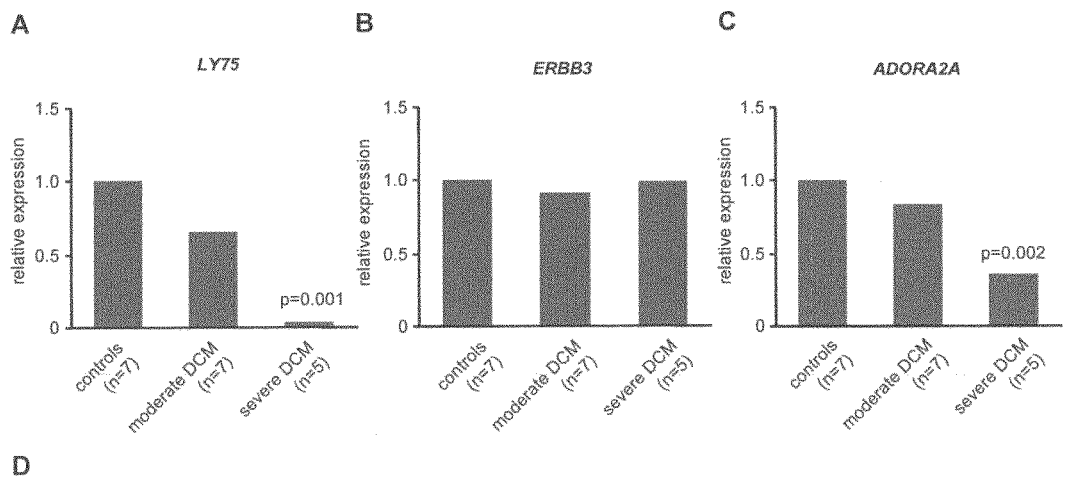
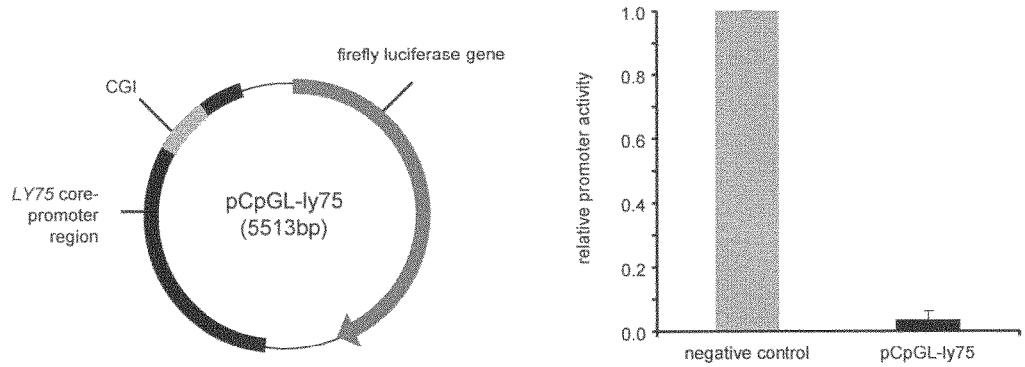
| | LY75 [ΔCT] | ERBB3 [ΔCT] | ADORA2A [ΔCT] |
|---|---|---|---|
| Controls (n=7) | 8.51 ± 0.66 | 9.88 ± 0.80 | 8.65 ± 0.26 |
| Moderate DCM (n=7) | 9.11 ± 0.40 | 10.02 ± 0.63 | 8.90 ± 0.53 |
| Severe DCM (n=5) | 13.11 ± 0.78 | 9.90 ± 0.53 | 10.08 ± 0.20 |

Figure 7
A
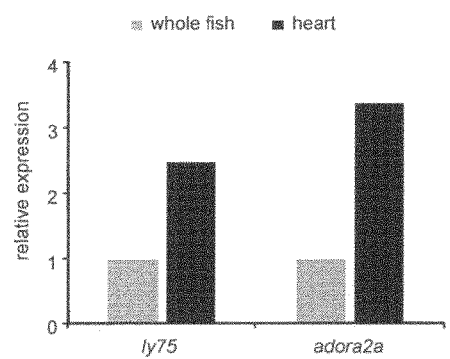
B
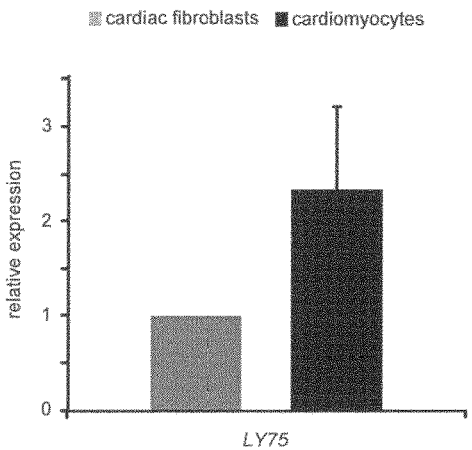
C
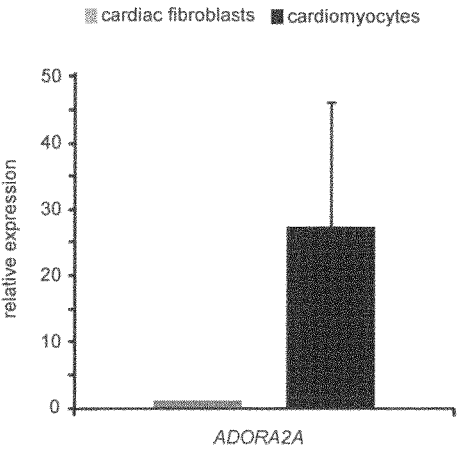

```
hadora2a    1  -XPIMGSSVYITVELAIAVLAILGNVLVCWAVWLNSNLQNVTNXFVVSLAAADIAVGVLAIPFAITISTG
madora2a    1  ----MGSSVYIMVELAIAVLAILGNVLVCWAVWXNSNLQNVTNFFVVSLAAADIAVGVLAIPFAITISTG
zadora2a    1  MXNNXFDVXYMXXELXIAXLSXLGNVLVCWAVGLNSNLQSXTNFFVVSLAXADIAVGVLAIPFSXVXSTG hadora2a   70  FCAACHGCLFIACFVLVLTQSSIFSLLAIAIDRYIAIRIPLRYNGLVTGTRAKGIIAICWVLSFAIGLTP
madora2a   67  FCAACHGCLFXACFVLVLTQSSIFSLLAIAIDRYIAIRIPLRYNGLVTGMRAKGIIAICWVLSFAIGLTP
zadora2a   71  FCANFYGCLFIACFVLVLTQSSIFSLLAIAIDRYIAIKIPLRYNSLVTGQRAXGIIAICWVLSVIIGLTP hadora2a  140  MLGWNNCGXPKEGKNHSQGCGEGQVACLFEDVVPMNYMVYFNFFACVLVPLLLMLXVYLRIFLAARRQLK
madora2a  137  MLGWNNCSQKXE--NSXKTCGEGRVTCLFEDVVPMNYMVYXNFFAFVLXPLLLMLAIYLRIFLAARRQLK
zadora2a  141  MLGWHKARLQXG---HNGTCPEGMXECLFEXVVVMDYMVYFNFFACVLVPLLLMLAIYLRIFXAARXQLK hadora2a  210  QMESQPLPGE-RARSTLQKEVHAAKSLAIIVGLFALCWLPLHIINCFTFFCPXCSHAPXWLMYLAIXLSH
madora2a  205  QMESQPLPGE-RXRSTLQKEVHAAKSLAIIVGLFALCWLPLHIINCFTFFCSTCQHAPPWLMYLAIILSH
zadora2a  208  CXESKAXECEXXRSTLQKEVHAAKSLAIIVGLFAVCWLPLHIINCFTXFCPXCERPPAIXMYLAIILSH hadora2a  279  XNSVVNPFIYAYRIREFRQTFRKIIRXHVLRQQEPFXAXGXSARVLAAHGSXGEQVSLRLNGHPPGVWAN
madora2a  274  XNSVVNPFIYAYRIREFRQTFRKIIRXHVLRRQEPFXACGSSAWALAAHSXXGEQVSLRLNGHPLGVWAN
zadora2a  278  ANSVVNPFIYAYRIREFRHTFRKIXRYHXLGRREPLSCNGSXR--TSTRXSVXXSLRIXXNGLVRELXAE hadora2a  349  GSAPHP--ERRPNGYALGLVSGG-----------SAQESQGNTGLPDVELLXHXLKGVCPXPPGLDDPLA
madora2a  344  GSAPHS--GRRPNGYTLGPGGGG-----------STQGSPG-----DVELLXQEHQ-EGQXHPGLXDXLA
zadora2a  346  QSSTTXSGESAEPGXTHRPVSTENSILDNQPIEISNSHRHTALRHPXSPLTGXNEGLACRKHAGLDITDG hadora2a  406  QDGAGVS---------------------
madora2a  395  QGRVGTASWSXEFAPS------------
zadora2a  416  KDLSSPLHIKSALYVQTAHCVELTEVS
```

EPIGENETIC SIGNATURES AS MARKER FOR CARDIOMYOPATHIES AND MYOCARDIAL INSUFFICIENCIES

CROSS REFERENCE TO A RELATED APPLICATION

This application is a National Stage Application of International Application Number PCT/EP2013/055267, filed Mar. 14, 2013; which claims the benefit of U.S. Provisional Application No. 61/610,841, filed Mar. 14, 2012; all of which are incorporated herein by reference in their entirety.

The Sequence Listing for this application is labeled "SeqList-06Sep16.txt" which was created on Sep. 6, 2016, and is 1037 KB. The entire content is incorporated herein by reference in its entirety.

The present invention relates to the use of DNA methylation profiles of patient samples for the diagnosis, prognosis and/or therapy monitoring of a heart disease in a patient, wherein the DNA methylation profile of the patient sample is compared with the DNA methylation profile of a control sample, and wherein a difference in the DNA methylation profile of the patient sample compared to the control sample is indicative of a heart disease or of the risk for developing a heart disease or for a prediction of therapy effects or therapy outcome. The present invention further relates to methods for the diagnosis, prognosis and/or therapy monitoring of a heart disease in a patient, comprising determining the DNA methylation profile in a patient sample comprising genomic DNA from heart cells, heart tissue or peripheral blood; and comparing the DNA methylation profile in the patient sample with the DNA methylation profile from a normal subject not having a heart disease or having a normal heart function. The present invention furthermore relates to kits that are suitable for the methods and uses of the invention. The present invention furthermore relates to the use of ADORA2A, ERBB3, LY75, HOXB13, GFI1, CLDN4, FDX1, ID4, NAT1, PPARGC1A, SULF2, TFF1, TKT, ATP2C, CCDC59, GSTM5m, SLC9A6 and TDG as marker for the diagnosis, prognosis and/or therapy monitoring of a heart disease in a patient.

BACKGROUND OF THE INVENTION

Cardiomyopathy is the deterioration of the function of the myocardium for any reason. People with cardiomyopathy are at risk of heart failure, arrhythmia and/or sudden cardiac death. Cardiomyopathy can often go undetected, making it especially dangerous to carriers of the disease. Cardiomyopathies can be categorized as extrinsic or intrinsic. An extrinsic cardiomyopathy is a cardiomyopathy where the primary pathology is outside the myocardium itself. Most cardiomyopathies are extrinsic, because by far the most common cause of a cardiomyopathy is ischemia. The World Health Organization calls these specific cardiomyopathies. An intrinsic cardiomyopathy is defined as weakness in the muscle of the heart that is not due to an identifiable external cause. This definition was used to categorize previously idiopathic cardiomyopathies although specific external causes have since been identified for many. The intrinsic cardiomyopathies consist of a variety of disease states, each with their own causes. Many intrinsic cardiomyopathies now have identifiable external causes including ischemia, drug and alcohol toxicity, viral infections and various genetic and idiopathic causes.

Dilated cardiomyopathy is one of the most frequent heart muscle diseases with an estimated prevalence of 1:2500. The progressive nature of this disorder is responsible for about 30-40% of all heart failure cases and is the main cause for heart transplantation in young adults. In the last decades, it was recognized that DCM has a substantial genetic contribution. It is estimated that about 30-40% of all DCM cases have a familial aggregation and until now more than 40 different genes were found to cause monogenetic DCM. However, since the course of the disease is highly variable and only a fraction of patients suffer a causal mutation, genetic modifiers are thought to play an important role (Friedrichs et al., 2009; Villard et al., 2011). Accordingly, several studies have now identified common genetic polymorphisms, which are associated with DCM or heart failure (Friedrichs et al., 2009; Villard et al., 2011). But even then, the existence of such modifiers also does not completely explain the high variability in phenotypic expression and unexplained cases of DCM.

Epigenetic mechanisms play important roles during normal development, aging and a variety of disease conditions. Numerous studies have implicated aberrant methylation in the etiology of human diseases, including cancer, MS and diabetes. Hypermethylation of CpG islands located in promoter regions of tumor suppressor genes is firmly established as the most frequent mechanism for gene activation in cancers.

Briefly, methylation of the 5' carbon of cytosine is a form of epigenetic modification that does not affect the primary DNA sequence, but affects secondary interactions that play a critical role in the regulation of gene expression. Aberrant DNA methylation may suppress transcription and subsequently gene expression.

Disease modification through epigenetic alterations has been convincingly demonstrated for different diseases (Jones and Baylin, 2002; Feinberg and Tycko, 2004). In the cardiovascular system, histone modifications and chromatin remodelling are thought to direct adaptive as well as maladaptive molecular pathways in cardiac hypertrophy and failure (Montgomery et al., 2007) and DNA methylation was found to be responsible for the hypermutability of distinct cardiac genes (Meurs and Kuan, 2011). Furthermore, recent studies have highlighted the potential interplay between environmental factors and the disease phenotype by epigenetic mechanisms (Jirtle and Skinner, 2007; Herceg and Vaissiere, 2011). However, the knowledge about the impact of epigenetic alterations on the disease phenotype in human patients is still very limited.

Thus, epigenetic mechanisms are increasingly recognized as contributors to human disease. Surprisingly, most studies conducted so far have focused on cancer and only few have investigated the role of epigenetic mechanisms, especially DNA methylation in cardiovascular disease (Movassagh et al., 2011). However, epigenetic mechanisms are thought to control key processes such as cardiac hypertrophy, fibrosis and failure (Backs et al., 2006; Backs et al., 2008).

Furthermore, the decision to initiate or escalate therapies (drugs, devices, surgical interventions) is currently based on assumptions and supported only by few diagnostic measures (Bielecka-Dabrowa et al., 2008).

There is a need for diagnostic means and methods that not only allow the detection of a heart disease but also allow to draw conclusions about the further development of an existing heart disease or whether a heart disease will develop in a patient.

SUMMARY OF THE INVENTION

According to the present invention this object is solved by the use of a DNA methylation profile of a patient sample comprising genomic DNA from heart cells, heart tissue or peripheral blood f for the diagnosis, prognosis and/or therapy monitoring of a heart disease in a patient, wherein the DNA methylation profile of the patient sample is compared with the DNA methylation profile of a control sample, and wherein a difference in the DNA methylation profile of the patient sample compared to the control sample is indicative of a heart disease or of the risk of developing a heart disease or for a prediction of therapy effects or therapy outcome.

According to the present invention this object is solved by a method f for the diagnosis, prognosis and/or therapy monitoring a heart disease in a patient, comprising
   determining the DNA methylation profile in a patient sample comprising genomic DNA from heart cells, heart tissue or peripheral blood; and
   comparing the DNA methylation profile in the patient sample with the DNA methylation profile from a normal subject not having a heart disease or having a normal heart function, wherein a difference in the DNA methylation profile is indicative of a heart disease or of the risk for developing a heart disease or for a prediction of therapy effects or therapy outcome.

According to the present invention this object is solved by providing a kit for the diagnosis, prognosis and/or therapy monitoring of a heart disease in a patient, comprising at least two sets of oligonucleotides, wherein the oligonucleotides of each set are identical, complementary or hybridize under stringent conditions to an at least 15 nucleotides long segment of a nucleic acid sequence selected from SEQ ID NOs. 1 to 18, and optionally, a reagent that distinguishes between methylated and non-methylated CpG dinucleotides.

According to the present invention this object is solved by providing at least one of ADORA2A, ERBB3, LY75, HOXB13, GFI1, CLDN4, FDX1, ID4, NAT 1, PPARGC1A, SULF2, TFF1, TKT, ATP2C, CCDC59, GSTM5m, SLC9A6 and TDG for use as a marker for the diagnosis, prognosis and/or therapy monitoring of a heart disease in a patient.

DESCRIPTION OF THE PREFERRED EMBODIMENTS OF THE INVENTION

Before the present invention is described in more detail below, it is to be understood that this invention is not limited to the particular methodology, protocols and reagents described herein as these may vary. It is also to be understood that the terminology used herein is for the purpose of describing particular embodiments only, and is not intended to limit the scope of the present invention which will be limited only by the appended claims. Unless defined otherwise, all technical and scientific terms used herein have the same meanings as commonly understood by one of ordinary skill in the art. For the purpose of the present invention, all references cited herein are incorporated by reference in their entireties.

Concentrations, amounts, and other numerical data may be expressed or presented herein in a range format. It is to be understood that such a range format is used merely for convenience and brevity and thus should be interpreted flexibly to include not only the numerical values explicitly recited as the limits of the range, but also to include all the individual numerical values or sub-ranges encompassed within that range as if each numerical value and sub-range is explicitly recited. As an illustration, a numerical range of "at least 15 nucleotides, preferably 15 to 100" should be interpreted to include not only the explicitly recited values of 15 to 100, but also include individual values and sub-ranges within the indicated range. Thus, included in this numerical range are individual values such as 15, 16, 17, 18, 19, 20, 21, . . . 96, 97, 98, 99 and 100 and sub-ranges such as from 20 to 80, from 30 to 70, from 15 to 40, from 25 to 50, from 15 to 25, and from 25 to 50, etc. This same principle applies to ranges reciting only one numerical value. Furthermore, such an interpretation should apply regardless of the breadth of the range or the characteristics being described.

Use of DNA Methylation Profiles as Diagnostic, Prognostic and/or Therapeutic Marker of a Heart Disease As described above, the present invention provides the use of a DNA methylation profile of a patient sample comprising genomic DNA from heart cells, heart tissue or peripheral blood for the diagnosis, prognosis and/or therapy monitoring of a heart disease in a patient.

Thereby, the DNA methylation profile of the patient sample is compared with the DNA methylation profile of a control sample.

A difference in the DNA methylation profile of the patient sample compared to the control sample is indicative:
   of a heart disease,
   of the risk of developing a heart disease,
   of the progression or advance of a heart disease, and/or
   for a prediction of therapy effects or therapy outcome.

As used herein, providing a diagnosis of a subject/patient is determining heart failure, namely independent on the etiology of the heart failure, i.e. determining whether or not a subject has suffered heart failure recently or in the past.

As used herein, providing a prognosis of a subject t/patient is preferably selected from determining heart failure severity, risk for subsequent all-cause mortality and risk assessment of the subject with heart failure or risk for developing heart failure.

"Risk assessment" or "risk stratification" of subjects or patients with heart failure according to the present invention refers to the evaluation of factors, such as DNA methylation profiles, mutations, biomarkers, in order to predict the risk of future events or even death and in order to decide about the type, manner, dosis, regimen of therapy and treatment for the individual subject.

"Disease classification" according to the present invention refers to the severity of the specific heart failure type.

Preferably, the prognosis of a heart disease comprises risk stratification and/or disease classification.

As used herein, "therapy monitoring" or "therapy management" of a heart disease comprises treatment monitoring or treatment decision making as well as the prediction of therapy effects or therapy outcome.

The "DNA methylation profile" according to the invention is preferably
   a genome-wide DNA methylation profile,
   a whole genome cardiac DNA methylation profile The "DNA methylation profile" according to the invention preferably comprises the DNA methylation levels of CpG islands or nucleotides.

Preferably, the "DNA methylation profile" according to the invention is a genome-wide DNA methylation profile of the CpG islands or nucleotides.

The difference in the DNA methylation profile of the patient sample compared to the DNA methylation profile of the control sample is preferably
   a different degree of CpG methylation.

CpG sites or CG sites are regions of DNA where a cytosine nucleotide occurs next to a guanine nucleotide in the linear sequence of bases along its length. "CpG" is shorthand for a cytosine and a guanine separated by only one phosphate, the "CpG" notation is used to distinguish this linear sequence from the CG base-pairing of cytosine and guanine. Cytosines in CpG dinucleotides can be methylated to form 5-methylcytosine. In mammals, methylating the cytosine within a gene can turn the gene off, a mechanism that is part of a larger field of science studying gene regulation that is called epigenetics. In mammals, 70% to 80% of CpG cytosines are methylated.

There are regions of the genome that have a higher concentration of CpG sites, known as CpG islands. Many genes in mammalian genomes have CpG islands associated with the start of the gene.

A "CpG island" as used herein and according to Takai and Jones (20002) is a region with:
- a nucleotide length of at least 200 bp, or
- with a GC percentage of 50% or higher, or
- with an observed versus expected CpG ratio that is 60% or higher (where the observed/expected CpG ratio is calculated by formula: number of CpG/(number of C×number of G))×total number of nucleotides in the sequence).

CpG islands typically occur at or near the transcription start site of genes, particularly housekeeping genes, in vertebrates. Normally a C (cytosine) base followed immediately by a G (guanine) base (a CpG) is rare in vertebrate DNA because the cytosines in such an arrangement tend to be methylated. This methylation helps distinguish the newly synthesized DNA strand from the parent strand, which aids in the final stages of DNA proofreading after duplication. However, over evolutionary time methylated cytosines tend to turn into thymines because of spontaneous deamination. While there is a special enzyme in human (Thymine-DNA glycosylase, or TDG) that specifically replaces T's from T/G mismatches, it is not sufficiently effective to prevent the relatively rapid mutation of the dinucleotides. The result is that CpGs are relatively rare unless there is selective pressure to keep them or a region is not methylated for some reason, perhaps having to do with the regulation of gene expression.

Preferably, the DNA methylation profiles are determined by hybridisation-based arrays or by the use of next-generation sequencing techniques, polymerase-based as well as ligase based sequencing technologies like pyrosequencing, sequencing by ligation, single-molecule sequencing or nanopore sequencing alone or in combination with the bisulfite treatment of cytosine nucleotides.

Variation of the DNA Methylation Profiles in Time

In a preferred embodiment, the DNA methylation profile of the patient sample is determined over time.

This embodiment is preferably used for therapy monitoring or therapy management, preferably during/for long term therapy monitoring The DNA methylation profile of the patient sample is determined at different time points, during therapy.

Thereby, the DNA methylation profile is preferably determined before or at the beginning of the therapy and is then determined at different time points during the therapy.

A change in the DNA methylation profile at these different time points, when compared to the DNA methylation profile of the first measured time point, can be an indication of the progression or advance of the heart disease in the patient and/or of the success of a therapy.

Assessment of Further Biomarkers or of Mutations

In an embodiment, further biomarkers and/or genetic mutations are determined in the patient sample.

Further biomarkers are, for example, well established metabolic biomarkes, e.g. troponins or NT-proBNP, The determination of such further biomarkers and/or genetic mutations, together with the methylation profile, contributes preferably to disease risk stratification in a combinatorial manner.

The heart disease is a cardiomyopathy, myocardial insufficiency, acute or chronic heart failure, such as dilated cardiomyopathy (DCM), hypertrophic cardiomyopathy (HCM), ischemic cardiomyopathy, diastolic dysfunction, myocardial infarction.

Cardiomyopathy, which literally means "heart muscle disease", is the deterioration of the function of the myocardium for any reason. Cardiomyopathies can generally be categorized into two groups, based on WHO guidelines: extrinsic and intrinsic cardiomyopathies.

Extrinsic cardiomyopathies are cardiomyopathies where the primary pathology is outside the myocardium itself. Most cardiomyopathies are extrinsic, because by far the most common cause of a cardiomyopathy is ischemia. Ischemic cardiomyopathy, for instance, is a weakness in the muscle of the heart due to inadequate oxygen delivery to the myocardium with coronary artery disease being the most common cause.

An intrinsic cardiomyopathy is weakness in the muscle of the heart that is not due to an identifiable external cause. The term intrinsic cardiomyopathy does not describe the specific etiology of weakened heart muscle. The intrinsic cardiomyopathies are a heterogeneous group of disease states, each with their own causes. Intrinsic cardiomyopathy has a number of causes including drug and alcohol toxicity, certain infections (including hepatitis C), and various genetic and idiopathic (i.e., unknown) causes. There are four main types of intrinsic cardiomyopathy: first, dilated cardiomyopathy (DCM), the most common form, and one of the leading indications for heart transplantation. In DCM the heart (especially the left ventricle) is enlarged and the pumping function is diminished. Second, hypertrophic cardiomyopathy (HCM or HOCM), a genetic disorder caused by various mutations in genes encoding sarcomeric proteins. In HCM the heart muscle is thickened, which can obstruct blood flow and prevent the heart from functioning properly. Third, arrhythmogenic right ventricular cardiomyopathy (ARVC) arises from an electrical disturbance of the heart in which heart muscle is replaced by fibrous scar tissue. The right ventricle is generally most affected. Fourth, restrictive cardiomyopathy (RCM) is the least common cardiomyopathy. The walls of the ventricles are stiff, but may not be thickened, and resist the normal filling of the heart with blood. Furthermore, noncompaction cardiomyopathy a more recent form of cardiomyopathy is recognized as its own separate type since the 1980's. It refers to a cardiomyopathy where the left ventricle wall has failed to properly grow from birth and such has a spongy appearance when viewed during an echocardiogram.

The patient sample is preferably a sample of left ventricular tissue (such as a LV biopsy), a sample of right ventricular tissue or peripheral blood.

The control sample is preferably from a normal subject not having a heart disease or having a normal heart function, i.e. having an unaltered myocardial function.

The inventors have measured genome-wide DNA methylation profiles of (DCM) patient samples and identified candidate genes with altered methylation status that have prognostic and diagnostic value for heart diseases and are suitable for therapy monitoring as well.

In a preferred embodiment, the methylation level of at least one of the following genes is different in the patient sample compared to the control sample:

| | | Genebank Accession No. ** |
|---|---|---|
| adenosine receptor A2A (ADORA2A) | SEQ ID NO. 1 | ENSG00000128271 |
| ERBB3 | SEQ ID NO. 2 | ENSG00000065361 |
| LY75 | SEQ ID NO. 3 | ENSG00000054219 |
| HOXB13 | SEQ ID NO. 4 | ENSG00000159184 |
| GFI1 | SEQ ID NO. 5 | ENSG00000162676 |
| CLDN4 | SEQ ID NO. 6 | ENSG00000189143 |
| FDX1 | SEQ ID NO. 7 | ENSG00000137714 |
| ID4 | SEQ ID NO. 8 | ENSG00000172201 |
| NAT1 | SEQ ID NO. 9 | ENSG00000171428 |
| PPARGC1A | SEQ ID NO. 10 | ENSG00000109819 |
| SULF2 | SEQ ID NO. 11 | ENSG00000196562 |
| TFF1 | SEQ ID NO. 12 | ENSG00000160182 |
| TKT | SEQ ID NO. 13 | ENSG00000163931 |
| ATP2C | SEQ ID NO. 14 | ENSG00000017260 |
| CCDC59 | SEQ ID NO. 15 | ENSG00000133773 |
| GSTM5m | SEQ ID NO. 16 | ENSG00000134201 |
| SLC9A6 | SEQ ID NO. 17 | ENSG00000198689 |
| TDG | SEQ ID NO. 18 | ENSG00000139372 |

** Ensembl Genebank (see www.ensembl.org)

All listed identifier and gene names and the corresponding gene sequences and gene related sequences like transcript and protein sequences were retrieved from the Ensembl database (http://www.ensembl.org) release 70 from January 2013. Which relates to either GRCh37.p10 (human) or Zv9 (zebrafish). The mentioned resources have also been used for primer design.

More preferably, the methylation level of at least one of ADORA2A, ERBB3 and LY75 is different in the patient sample compared to the control sample.

More preferably, the methylation level of at least one of LY75, ADORA2A, ERBB3 and HOXB13 is different in the patient sample compared to the control sample.

More preferably, the methylation level of at least one of LY75, ADORA2A, ERBB3, HOXB13 and GFI1 is different in the patient sample compared to the control sample Preferably, the methylation level of at least one of ADORA2A, ERBB3, HOXB13, CLDN4, FDX1, ID4, NAT1, PPARGC1A, SULF2, TFF1 and TKT (SEQ ID NOs. 1, 2, 4, 6-13) is reduced in the patient sample compared to the control sample (hypo-methylation), more preferably of at least one of ADORA2A, ERBB3, HOXB13.

Preferably, the methylation level of at least one of LY75, GFI1, ATP2C, CCDC59, GSTM5m, SLC9A6 and TDG (SEQ ID NOs. 3, 5, 14-18) is higher in the patient sample compared to the control sample (hyper-methylation), more preferably of LY75.

LY75 is a collagen-binding mannose family receptor that is transcriptionally controlled by the Interleukin-6 receptor IL6Rα (Giridhar et al., 2011). For LY75, the dys-methylated CpGs reside within a classical CpG island covering Exon 1 as well as part of the 5' upstream region. Its transcriptional start-site is predicted in very close vicinity (1,395 bp). Our findings of a significantly increased DNA methylation together with strongly reduced LY75-mRNA levels in DCM patients suggested a functional role. While it is to our knowledge not possible to recreate exactly the same methylation patterns in vitro as seen in the primary tissue, we could investigate here the functional consequence of global LY75 promoter methylation, suggesting a direct link between methylation and transcriptional activity. We also knocked down ly75 in the zebrafish model and find not only cardiac dysfunction in ly75-ablated embryos, but also a noticeable skin detachment phenotype, potentially due to disturbed collagen production.

The adenosine receptor A2A (ADORA2A) is a member of the G protein-coupled receptor family and is highly abundant in neurons of basal ganglia, T lymphocytes, platelets, and vasculature, but also shows relevant expression in myocardium as shown herein. In the heart, activation of ADORA2A enhances cAMP production through αGs proteins (Sommerschild et al., 2000) and overexpression results in increased contractility and sarcoplasmic reticulum $Ca^{2+}$ uptake (Hamad et al., 2010) as well as cardio protection in ischemia and reperfusion damage (Urmaliya et al., 2009). Surprisingly, although ADORA2A methylation is reduced, we find mRNA levels to be significantly down-regulated. Hence, hyper-methylation can sometimes result in increased gene expression as observed in the case of ADORA2A. Our CGI annotation was based on the criteria by Takai and Jones (2002), which define a CpG island as a nucleotide sequence of 200 bp or greater in length or with a GC content of 50% or more, or a ratio of observed versus expected CpGs of 0.6 or higher. In case of ADORA2A, the tested CGIs only met the second criterion and may therefore not be classical CGIs.

The receptor tyrosine-protein kinase ERBB3 belongs to the membrane bound epidermal growth factor receptor (EGFR) family. Functionally it is implicated in SOX10 mediated neural crest and early heart development (Erickson et al., 1997). However, since knock-out of ERBB3 leads to early embryonic lethality, its role in regulation of cardiac contractility was previously unknown. In the present invention, the inventors used the zebrafish as animal model for investigating the functional role of ERBB3. Knock-down of erbb3b results in a similar, but earlier phenotype as adora2a. Additionally, erbb3b-morphants show regurgitation of blood into the ventricle, suggesting impaired cardiac valve development. cDNA splice-site analysis revealed a completely insertion of intron 2 as well a partial exclusion exon 2 producing an aberrant, frameshifted transcripts with premature termination codons.

The HOXB13 gene is a member of the homeobox gene family and is encoding a transcription factor. The homeobox gene family clusters on chromosome 17 in the 17qw21-22 region and is highly conserved and essential for vertebrate development.

Methods for the Diagnosis, Prognosis and/or Therapy Monitoring of a Heart Disease in a Patient As described above, the present invention provides a method for the diagnosis, prognosis and/or therapy monitoring of a heart disease in a patient.

The method comprises
  determining the DNA methylation profile in a patient sample comprising genomic DNA from heart cells, heart tissue or peripheral blood; and
  comparing the DNA methylation profile in the patient sample with the DNA methylation profile from a normal subject not having a heart disease or having a normal heart function.

As described above, a difference in the DNA methylation profile of the patient sample compared to the control sample is indicative:
  of a heart disease,
  of the risk of developing a heart disease, and/or
  for a prediction of therapy effects or therapy outcome.
The method furthermore preferably comprising the step of
  contacting genomic DNA isolated from the patient sample with at least one reagent that distinguishes between methylated and non-methylated CpG dinucleotides.

Reagents that distinguish between methylated and non-methylated CpG dinucleotides are known in the art, such as bisulfite, hydrogen sulfite, disulfite, and combinations thereof.

In a preferred embodiment, the DNA methylation profile of the patient sample is determined over time at different time points, preferably during therapy monitoring, as described above.

Preferably, the DNA methylation profiles are determined by hybridisation-based arrays or by the use of next-generation sequencing techniques, polymerase-based as well as ligase based sequencing technologies like pyrosequencing, sequencing by ligation, single-molecule sequencing or nanopore sequencing alone or in combination with the bisulfite conversion/treatment of cytosine nucleotides.

As described above, the heart disease is a cardiomyopathy, myocardial insufficiency, acute or chronic heart failure, such as dilated cardiomyopathy (DCM), hypertrophic cardiomyopathy (HCM), ischemic cardiomyopathy, diastolic dysfunction, myocardial infarction.

The patient sample is preferably a sample of left ventricular tissue (such as a LV biopsy), a sample of right ventricular tissue or peripheral blood.

The control sample is preferably from a normal subject not having a heart disease or having a normal heart function, i.e. having an unaltered myocardial function.

As described above, the prognosis of a heart disease preferably comprises risk stratification and/or disease classification.

As described above, the therapy monitoring of a heart disease preferably comprises treatment monitoring or treatment decision making as well as the prediction of therapy effects or therapy outcome.

The inventors have measured genome-wide DNA methylation profiles of (DCM) patient samples and identified candidate genes with altered methylation status that have prognostic and diagnostic for heart diseases and are suitable for therapy monitoring as well.

In a preferred embodiment, the methylation level of at least one of the following genes is different in the patient sample compared to the control sample:

|   |   | Genebank Accession No. ** |
|---|---|---|
| adenosine receptor A2A (ADORA2A) | SEQ ID NO. 1 | ENSG00000128271 |
| ERBB3 | SEQ ID NO. 2 | ENSG00000065361 |
| LY75 | SEQ ID NO. 3 | ENSG00000054219 |
| HOXB13 | SEQ ID NO. 4 | ENSG00000159184 |
| GFI1 | SEQ ID NO. 5 | ENSG00000162676 |
| CLDN4 | SEQ ID NO. 6 | ENSG00000189143 |
| FDX1 | SEQ ID NO. 7 | ENSG00000137714 |
| ID4 | SEQ ID NO. 8 | ENSG00000172201 |
| NAT1 | SEQ ID NO. 9 | ENSG00000171428 |
| PPARGC1A | SEQ ID NO. 10 | ENSG00000109819 |
| SULF2 | SEQ ID NO. 11 | ENSG00000196562 |
| TFF1 | SEQ ID NO. 12 | ENSG00000160182 |
| TKT | SEQ ID NO. 13 | ENSG00000163931 |
| ATP2C | SEQ ID NO. 14 | ENSG00000017260 |
| CCDC59 | SEQ ID NO. 15 | ENSG00000133773 |
| GSTM5m | SEQ ID NO. 16 | ENSG00000134201 |
| SLC9A6 | SEQ ID NO. 17 | ENSG00000198689 |
| TDG | SEQ ID NO. 18 | ENSG00000139372 |

** Ensembl Genebank (see www.ensembl.org)

All listed identifier and gene names and the corresponding gene sequences and gene related sequences like transcript and protein sequences were retrieved from the Ensembl database (http://www.ensembl.org) release 70 from January 2013. Which relates to either GRCh37.p10 (human) or Zv9 (zebrafish). The mentioned resources have also been used for primer design.

More preferably, the methylation level of at least one of ADORA2A, ERBB3 and LY75 is different in the patient sample compared to the control sample.

More preferably, the methylation level of at least one of ADORA2A, ERBB3, HOXB13 and LY75 is different in the patient sample compared to the control sample.

More preferably, the methylation level of at least one of LY75, ADORA2A, ERBB3 and HOXB13 is different in the patient sample compared to the control sample.

More preferably, the methylation level of at least one of LY75, ADORA2A, ERBB3, HOXB13 and GFI1 is different in the patient sample compared to the control sample Preferably, the methylation level of at least one of ADORA2A, ERBB3, HOXB13, CLDN4, FDX1, ID4, NAT1, PPARGC1A, SULF2, TFF1 and TKT (SEQ ID NOs. 1, 2, 4, 6-13) is reduced in the patient sample compared to the control sample (hypo-methylation), more preferably at least one of ADORA2A, ERBB3, HOXB13.

Preferably, the methylation level of at least one of LY75, GFI1, ATP2C, CCDC59, GSTM5m, SLC9A6 and TDG (SEQ ID NOs. 3, 5, 14-18) is higher in the patient sample compared to the control sample (hyper-methylation), more preferably of LY75.

Kits for the Diagnosis, Prognosis and/or Therapy Monitoring of a Heart Disease in a Patient As described above, the present invention provides a kit for the diagnosis, prognosis and/or therapy monitoring of a heart disease in a patient.

The kit comprises at least two sets of oligonucleotides, wherein the oligonucleotides of each set are identical, complementary or hybridize under stringent conditions to an at least 15 nucleotides long segment of a nucleic acid sequence selected from SEQ ID NOs. 1 to 18, preferably 15 to 100 nucleotides long segment of a nucleic acid sequence selected from SEQ ID NOs. 1 to 18, such as 20 to 80 or 30 to 70, such as about 25 nucleotides.

The kit optionally comprises a reagent that distinguishes between methylated and non-methylated CpG dinucleotides.

The kit is preferably suitable for the use of/with/in hybridisation-based arrays or next-generation sequencing techniques, polymerase-based as well as ligase based sequencing technologies, like pyrosequencing, sequencing by ligation, single-molecule sequencing or nanopore sequencing alone or in combination with the bisulfite treatment/conversion of cytosine nucleotides.

Thus, the kit comprises at least two sets of oligonucleotides for the detection of two target nucleic acids/genes (selected from SEQ ID NOs. 1 to 18).

Reagents that distinguish between methylated and non-methylated CpG dinucleotides are known in the art, such as bisulfite, hydrogen sulfite, disulfite, and combinations thereof.

As described above, the prognosis of a heart disease preferably comprises risk stratification and/or disease classification.

As described above, the therapy monitoring of a heart disease preferably comprises treatment monitoring or treatment decision making as well as the prediction of therapy effects or therapy outcome.

Markers for Heart Diseases

As described above, the present invention provides the use of at least one of ADORA2A, ERBB3, LY75, HOXB13, GFI1, CLDN4, FDX1, ID4, NAT1, PPARGC1A, SULF2, TFF1, TKT, ATP2C, CCDC59, GSTM5m, SLC9A6 and TDG as marker for the diagnosis, prognosis and/or therapy monitoring of a heart disease in a patient.

|  |  | Genebank Accession No. ** |
|---|---|---|
| adenosine receptor A2A (ADORA2A) | SEQ ID NO. 1 | ENSG00000128271 |
| ERBB3 | SEQ ID NO. 2 | ENSG00000065361 |
| LY75 | SEQ ID NO. 3 | ENSG00000054219 |
| HOXB13 | SEQ ID NO. 4 | ENSG00000159184 |
| GFI1 | SEQ ID NO. 5 | ENSG00000162676 |
| CLDN4 | SEQ ID NO. 6 | ENSG00000189143 |
| FDX1 | SEQ ID NO. 7 | ENSG00000137714 |
| ID4 | SEQ ID NO. 8 | ENSG00000172201 |
| NAT1 | SEQ ID NO. 9 | ENSG00000171428 |
| PPARGC1A | SEQ ID NO. 10 | ENSG00000109819 |
| SULF2 | SEQ ID NO. 11 | ENSG00000196562 |
| TFF1 | SEQ ID NO. 12 | ENSG00000160182 |
| TKT | SEQ ID NO. 13 | ENSG00000163931 |
| ATP2C | SEQ ID NO. 14 | ENSG00000017260 |
| CCDC59 | SEQ ID NO. 15 | ENSG00000133773 |
| GSTM5m | SEQ ID NO. 16 | ENSG00000134201 |
| SLC9A6 | SEQ ID NO. 17 | ENSG00000198689 |
| TDG | SEQ ID NO. 18 | ENSG00000139372 |

** Ensembl Genebank (see www.ensembl.org)

All listed identifier and gene names and the corresponding gene sequences and gene related sequences like transcript and protein sequences were retrieved from the Ensembl database (http://www.ensembl.org) release 70 from January 2013. Which relates to either GRCh37.p10 (human) or Zv9 (zebrafish). The mentioned resources have also been used for primer design.

In a preferred embodiment at least one of ADORA2A, ERBB3 and LY75 are used as such a marker.

In a preferred embodiment at least one of LY75, ADORA2A, ERBB3 and HOXB13 are used as such a marker.

In a preferred embodiment at least one of LY75, ADORA2A, ERBB3, HOXB13 and GFI1 are used as such a marker.

Preferably, the use of said (target) genes, nucleic acids or polypeptides encoded by the genes/nucleus acids as biomarkers comprises determining the methylation level of at least one of SEQ ID NOs. 1-18 in a patient sample comprising genomic DNA from heart cells, heart tissue or peripheral blood; and comparing it with the methylation level from a normal subject not having a heart disease, wherein, and as described above, a difference in the DNA methylation profile is indicative of a heart disease or of the risk for developing a heart disease or for a prediction of therapy effects or therapy outcome.

Preferably, and as described above, the heart disease is a cardiomyopathy, myocardial insufficiency, heart failure (acute or chronic),
such as DCM dilated cardiomyopathy (DCM), hypertrophic cardiomyopathy (HCM), ischemic cardiomyopathy, diastolic dysfunction, myocardial infarction.

Preferably, and as described above, the patient sample is a sample of left ventricular tissue, right ventricular tissue or peripheral blood.

Preferably, and as described above, the control sample is from a normal subject not having a heart disease or having a normal heart function.

As described above, the prognosis of a heart disease preferably comprises risk stratification and/or disease classification.

As described above, the therapy monitoring of a heart disease preferably comprises treatment monitoring or treatment decision making as well as the prediction of therapy effects or therapy outcome.

Further Description of the Invention

Summary

Problem: Dilated cardiomyopathy (DCM) is one the most frequent heart muscle diseases. Although several factors including genetic mechanisms are found to cause DCM, we still find many cases unexplained and observe a high phenotypic variability with respect to disease severity and prognosis. Epigenetic mechanisms are increasingly recognized as causes and modulators of human disease. Therefore, we studied genome-wide cardiac DNA methylation in DCM patients and controls to detect a possible epigenetic contribution to DCM.

Results: We detected distinct DNA methylation patterns in left ventricular heart tissue of DCM patients and replicated the epigenetic mode of regulation for several genes with previously unknown function in DCM, namely Lymphocyte antigen 75 (LY75), Tyrosine kinase-type cell surface receptor HER3 (ERBB3), Homeobox B13 (HOXB13), and Adenosine receptor A2A (ADORA2A). The results were carefully verified by alternative techniques in a well phenotyped and large independent cohort of DCM patients and controls. Furthermore, we are able to show the functional relevance for the contribution of the identified genes in the pathogenesis of heart failure by using the zebrafish as an in vivo model.

Impact: Our results hint at a novel layer in the pathogenesis of DCM and heart failure and have an impact on the development of novel biomarkers and future therapeutic strategies.

Discussion

In the present study, genome-wide cardiac DNA methylation was examined for the first time in patients with idiopathic DCM and controls. We detected methylation differences in pathways related to heart disease, but also in genes with yet unknown function in DCM or heart failure, namely Lymphocyte antigen 75 (LY75), Tyrosine kinase-type cell surface receptor HER3 (ERBB3), Homeobox B13 (HOXB13), and Adenosine receptor A2A (ADORA2A). Mass-spectrometric analysis and bisulfate-sequencing enabled confirmation of the observed DNA methylation changes in independent cohorts. Aberrant DNA methylation in DCM patients was associated with significant changes in LY75 and ADORA2A mRNA expression, but not in ERBB3 and HOXB13. By in vivo studies of orthologous ly75 and adora2a in zebrafish, we could demonstrate for the first time a functional role of these genes in adaptive or maladaptive pathways in heart failure.

In detail, we investigated here DNA methylation patterns on a genome-wide level in myocardium from patients with idiopathic DCM and functionally unaffected hearts of patients who had received heart transplantation. We found and confirmed aberrant DNA methylation alterations in a number of CGIs, suggesting that DNA methylation is associated with cardiac function and may modulate phenotypic characteristics of idiopathic DCM.

Recently, Movassagh et al. (2011) reported distinct epigenomic features in explanted human failing hearts, highlighting a potential role of DNA methylation also in end-stage heart failure. However, feasibility of the used methyl-DNA precipitation and sequencing is restricted by the relatively large amounts of required tissue, which is not easily available from living patients.

Furthermore, handling of the tissue and time points of DNA isolation were quite different in controls and patients. Tissue specimens from explanted hearts of end-stage heart failure patients may be altered due to tissue handling and could have undergone secondary alterations because of degradation, missing oxygenation, innervation, and arrest of pumping function (Talens et al., 2010). Also, the authors did not replicate their findings, which were obtained in 4 patients, in an independent series of unrelated samples and by an alternative methodology. Therefore, we used a different approach, confirmed our findings in a large replication cohort with two alternative methodologies and applied functional studies to underscore the relevance of our results.

Since availability of appropriate myocardial tissue from living patients is limited, studies on epigenetic alterations in patients with heart disease are rare. As a primary referral center for cardiomyopathies, we could enroll a high number of patients and controls in this study. Our controls are not completely healthy, but had previously received heart transplantation. Hence, potential confounders include patient's medication and medical history. Importantly, on the functional level all controls had an unconstrained cardiac function as a prerequisite and we could apply the exactly same standardized procedure to sample and process left ventricular biopsies from DCM patients and controls. However, all controls received immunosuppressive medications to prevent organ rejection. This medication might influence on at least some genes. As shown herein, we found unchanged methylation levels for the tested genes in control subjects before and after heart transplantation, showing that immunosuppressives do not, at least in whole peripheral blood, impact on CGI DNA methylation of LY75, ADORA2A, ERBB3 and HOXB13.

Tissue samples are composed of different cell types, which might change during disease progression. In the present study, we have paid special attention to patient selection and the process of tissue sampling. Consequently, this resulted in high homogeneity of overall methylation patterns as shown above. In a study by Grzeskowiak et. al (2003) it was demonstrated that differences in gene expression of LV myocardial biopsies from controls and idiopathic DCM patients are almost exclusively due to genes expressed in cardiomyocytes and that the contribution of the second most common cell type, fibroblasts, is rather low and mostly unchanged during DCM. The increased fibrosis observed in human DCM, for instance, seems to be mainly due to extracellular collagen deposition rather than an increase of cardiofibroblasts. Our in vivo experiments clearly underline that reduced expression of LY75 and ADORA2A in cardiomyocytes leads to heart failure as observed in our patients. Together, this approach allowed us to study epigenetic mechanisms and its functional consequences without the confounding background of organ hypoxia and apoptosis in explanted hearts of deceased patients.

In a funnel approach, we first investigated global methylation patterns and found that methylation patterns also reflect cardiac disease pathways. Our global methylation analyses identified cardiac disease pathways and were complemented by extensive validation studies applying the highly precise MassARRAY and bisulfite sequencing techniques. We found 12 of 20 genes showing the same direction of dys-methylation as found in the screening stage, and four reached statistical significance. This has at least three reasons: 1) we expected a high false positive rate due to the relatively small screening cohorts in contrast to the number of measured epigenetic features, 2) we performed the replication measurements with a completely independent methodology, and 3) we carried out these analyses in independent patients and controls. Therefore, the genes identified here represent consistently validated targets that show an epigenetic mode of regulation.

The deciphering of the functional implications of changes in DNA methylation is difficult but of pivotal importance. Since in many cases changes in CpG methylation are correlated to the accessibility of DNA to transcription factors and polymerases, measurements of mRNA levels represent an appropriate methodology. In the present study, we find that methylation of novel cardiac genes is altered in patients with DCM. Hence, it can be hypothesized that the dys-methylated and dys-regulated genes also exert a functional role in the heart.

The receptor tyrosine-protein kinase ERBB3 belongs to the membrane bound epidermal growth factor receptor (EGFR) family. Functionally it is implicated in SOX10 mediated neural crest and early heart development (Erickson et al., 1997). However, since knock-out of ERBB3 leads to early embryonic lethality, its role in regulation of cardiac contractility was previously unknown. Although we could not observe changes in ERBB3 transcript levels, the significant changes in DNA methylation could be a susceptibility factor mediated through yet unknown pathways, e.g. by exerting effects on DNA stability, ERBB3 isoform expression, or Histon binding.

LY75, a collagen-binding mannose family receptor, is transcriptionally controlled by the Interleukin-6 receptor IL6Rα (Giridhar et al., 2011) and mediates antigen uptake and presentation in a Clathrin-dependent manner. For DCM, a correlation of IL-6 levels and cross-linked type I collagen was found, potentially implicating a role of IL-6/LY75 signaling in cardiac remodeling (Timonen et al., 2008). For LY75, the dys-methylated CpGs reside within a classical CpG island covering Exon 1 as well as part of the 5' upstream region. Its transcriptional start-site is predicted in very close vicinity (1,395 bp). Our findings of a significantly increased DNA methylation together with strongly reduced LY75-mRNA levels in DCM patients suggested a functional role. While it is to our knowledge not possible to recreate exactly the same methylation patterns in vitro as seen in the primary tissue, we could investigate here the functional consequence of global LY75 promoter methylation, suggesting a direct link between methylation and transcriptional activity. We also knocked down ly75 in the zebrafish model and find not only cardiac dysfunction in ly75-ablated embryos, but also a noticeable skin detachment phenotype, potentially due to disturbed collagen production.

The adenosine receptor A2A (ADORA2A) is a member of the G protein-coupled receptor family and is highly abundant in neurons of basal ganglia, T lymphocytes, platelets, and vasculature, but also shows relevant expression in myocardium as shown herein. In the heart, activation of ADORA2A enhances cAMP production through αGs proteins (Sommerschild et al., 2000) and overexpression results in increased contractility and sarcoplasmic reticulum $Ca^{2+}$ uptake (Hamad et al., 2010) as well as cardio protection in ischemia and reperfusion damage (Urmaliya et al., 2009). Surprisingly, although ADORA2A methylation is reduced, we find mRNA levels to be significantly down-regulated. Such a positive relationship was described for other genes and is not fully understood in each case (Zhang et al., 2006). Our CGI annotation was based on the criteria by Takai and Jones (2002), which define a CpG island as a nucleotide sequence of 200 bp or greater in length or with a GC content of 50% or more, or a ratio of observed versus expected CpGs of 0.6 or higher. In case of ADORA2A, the tested CGIs only met the second criterion and may therefore not be classical CGIs.

For such sites, one explanation can be that hyper-methylation cannot only impede the binding of transcriptional activators but also can affect repressors of transcription. We therefore performed an in silico analysis of the promoter region of ADORA2A and found two binding-sites of the transcription factor CTCF (CCCTC-binding factor) in close vicinity to both significantly hypo-methylated CGIs, but not within the single unaffected CGI of ADORA2A. CTCF is a unique insulator-binding protein, which can act as transcriptional repressor by blocking distinct enhancer regions (Bell et al., 1999; Gaszner and Felsenfield, 2006). Intriguingly, CTCF sites emerge as central players in regulatory networks linking gene regulation with epigenetic modifications (Bell and Felsenfield, 2000). Accordingly, our observed decrease in ADORA2A expression might be a result of enhanced binding of CTCF-repressors due to CGI hypomethylation. One explanation is that hyper-methylation cannot only silence the binding of transcriptional activators, but also affect repressors of transcription. Hence, hyper-methylation can sometimes result in increased gene expression as observed in the case of ADORA2A.

The detection of epigenetic mechanisms in human heart disease represents an attractive option to identify and dissect and later in target completely novel pathomechanisms. Hence, the validated targets from this study that have shown functional relevance are most likely modifiers of DCM rather than being independent disease causes and can, thus, can be further investigated for their diagnostic and therapeutic potential. Therefore, it is reasonable to investigate their potential as diagnostic and therapeutic targets specifically in DCM but also in heart failure due to other causes. In the cancer field, epigenetic drugs have already entered the clinical arena (e.g. Decitabine or Azacitidine in the treatment of myelodysplastic syndromes), and methylation patterns are used as biomarkers to subtype and stage various cancers as a critical step towards a more effective personalized care (Coppede 2011; Litzow 2011). Hence, the genes identified here are relevant druggable targets in DCM and heart failure and aid in disease classification or risk stratification.

The following examples and drawings illustrate the present invention without, however, limiting the same thereto.

A) Correlation plot showing the percentage of CpG methylation in controls versus DCM patients resulting in an overall very high correlation. Overall, correlation between both cohorts is high, however some outliers show hyper- or hypo-methylation in cases.

B) Gene-Set Enrichment Analysis for NIA human disease pathways. The area proportional Venn diagram shows that methylation changes in cardiovascular disease genes are significantly enriched together with the overlap of the other indicated gene sets.

C) Cluster analysis for genes with known expression in the human heart and significantly altered methylation. The color code used for the heatmap is shown in the upper left corner, values range from 1 (sample with the lowest methylation for the considered gene) to 17 (sample with the highest methylation for the considered genes). Genes with higher methylation found in controls cluster in the upper right quarter. Genes with higher methylation in DCM gather in the lower left quarter. Hypomethylation is shown for genes clustering in the upper left quarter for DCM and lower right quarter for controls.

Figure 2:
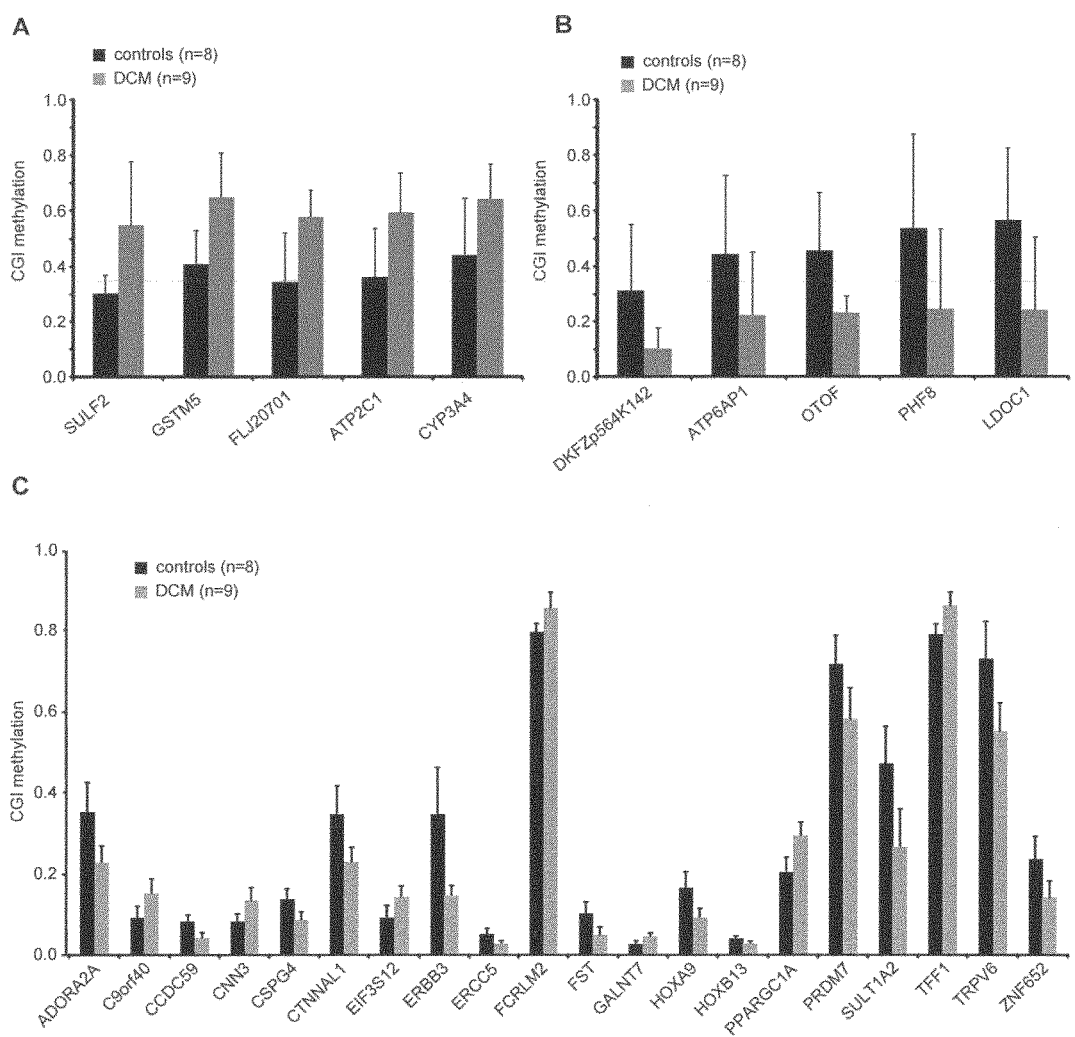

FIG. 2 Differentially methylated genes in DCM patients.

A-C) Bar graphs showing the degree of methylation of CGIs of the screening cohort (n=9 DCM patients; n=8 controls). The 5 genes with the largest increase in methylation in DCM patients are shown in A) and genes with the largest decrease in methylation are displayed in B). C) Shown are the 20 genes with the most significant methylation changes in the screening phase. Error bars indicating standard deviation.

Figure 3:
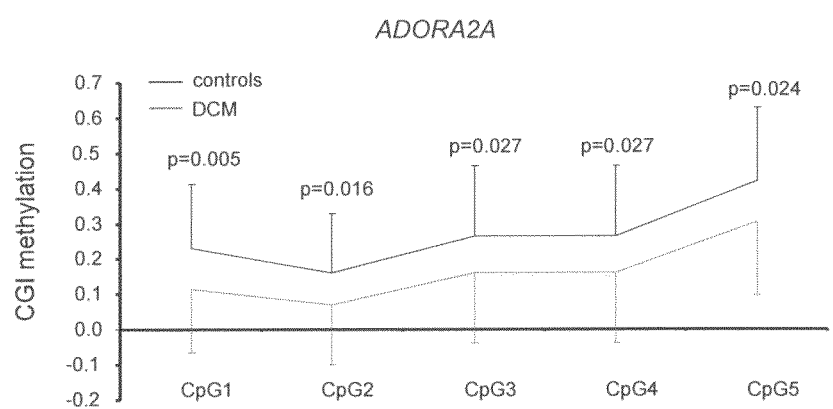

FIG. 3 MassARRAY-based validation of dys-methylated genes.

A and B) MassARRAY-based validation of differential methylation in LY75 and ERBB3. DCM patients show significantly increased DNA methylation in LY75 (A), while ERBB3 is significantly lower methylated (B). The schemes above the methylation graphs represent the tested CGIs (CGI-1, CGI-2, CGI-3), in relation to the predicted transcription start-site (leftmost vertical line), the exons (black bars) and alternatively spliced exons (white boxes) of the genes. A) The box and whiskers plot (min to max) on the upper left side represents the mean CpG methylation measured by MassARRAY, the individual CpG methylation is shown at the bottom. The pattern of CpG methylation in multiple clones is shown on the upper right insert. B) The box and whiskers plot (min to max) on the left side represents the mean CpG methylation measured by MassARRAY, the individual CpG methylation is shown on the right.

C and D) MassARRAY-based validation of differential methylation in HOXB13 and ADORA2A.

DCM patients show significantly decreased DNA methylation in HOXB13 (A) and ADORA2A (B). A) The box and whiskers plot (min to max) on the left side represents the mean CpG methylation measured by MassARRAY, the individual CpG methylation is shown on the right. B) The scheme above the graph represents the tested CGI, in relation to the predicted transcription start site (leftmost vertical line), the exons (black boxes) and alternatively spliced exons (white boxes) of adora2a. Dashed lines indicate the 1500 bp up- and downstream region of the CGIs wherein the listed transcription factor binding sites are found. Boxplots below show the mean methylation in DCM and controls at the corresponding CGI. The pattern of CpG methylation as assessed by bisulfite-sequencing in multiple clones is shown for CGI-1 at the bottom of the figure.

(E) MassARRAY-based validation of differential methylation in ADORA2A. Graph representing individual CpG methylation in ADORA2A measured by MassARRAY in DCM patients and controls.

FIG. 4 MassARRAY-based validation of further dys-methylated genes.

Graphs representing the mean CGI methylation of targets included in the replication stage. DCM patients show a reduction in methylation level in CLDN4, FDX1, ID4, NAT1, PPARGC1A, SULF2, TFF1, TKT, FLJ20701 and an increase of methylation in ATP2C, CCDC59, GFI1, GSTM5m, SLC9A6, and TDG.

Figure 5:
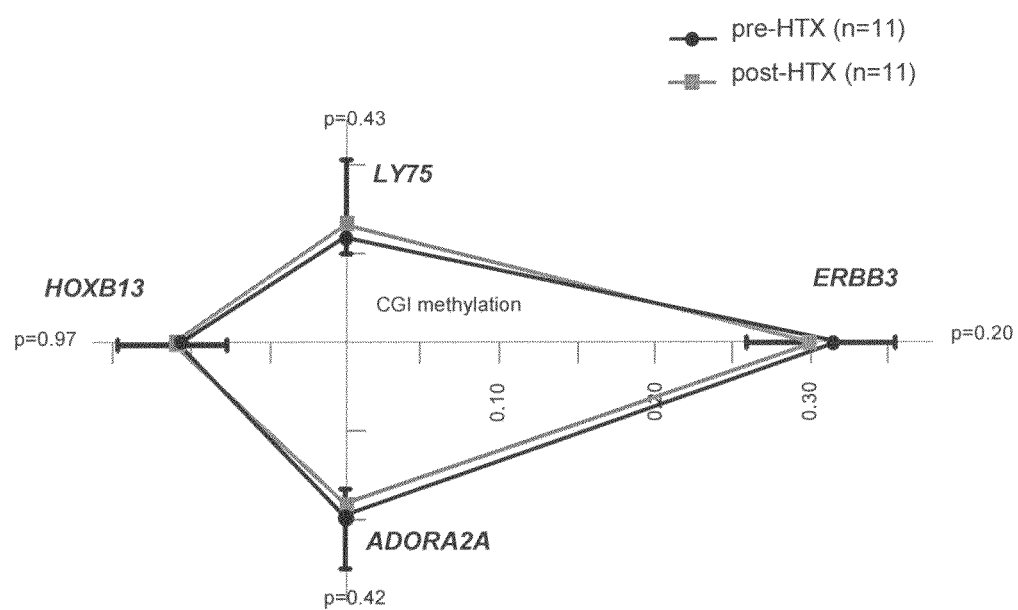

FIG. 5 CpG island methylation of control subjects before and after heart transplantation.

The line diagram shows the highly similar degree of methylation of DNA derived from peripheral blood of control subjects pre- (circlescattered line) and post- (squaresscattered line) heart transplantation (n=11) for LY75, ADORA2A, ERBB3 and HOXB13. Error bars indicating standard deviation.

FIG. 6 mRNA Expression of genes with altered methylation status and gene promoter analysis.

A-C) Bar graphs showing relative mRNA expression levels of LY75, ERBB3 and ADORA2A in mild and moderate-severe DCM in comparison to controls. A) LY75 expression is strongly reduced (relative expression=0.04), while ERBB3 (B) mRNA levels are not differentially regulated. C) ADORA2A is also significantly down-regulated in DCM (relative expression=0.37).

D) Given are the mean delta-CT values (±SEM) of LY75, ERBB3, and ADORA2A in the different groups (controls, moderate DCM, severe DCM). The reference is based on the mean of the three housekeeper genes: GAPDH, RPL13, β-Actin.

E) Left: Schema of the vector construct to measure LY75 promoter activity without and after treatment with the methylase SssI. Right: Relative promoter activity (mean of 3 technical replicates±SD) showing the strongly reduced activity in LY75 after methylation, whereas the negative control does not show significant differences.

FIG. 7 ly75 and adora2a tissue and cell-type expression.

A) Relative expression levels of ly75 and adora2a quantified by q-PCR in 40 whole zebrafish embryos (grey bars) and 200 isolated zebrafish embryonic hearts (black bars). B-C) Expression of ly75 and adora2a in neonatal rat cardiomyocytes and cardiofibroblasts (n=3 biological replicates). Error bars indicating standard deviation.

Figure 8:
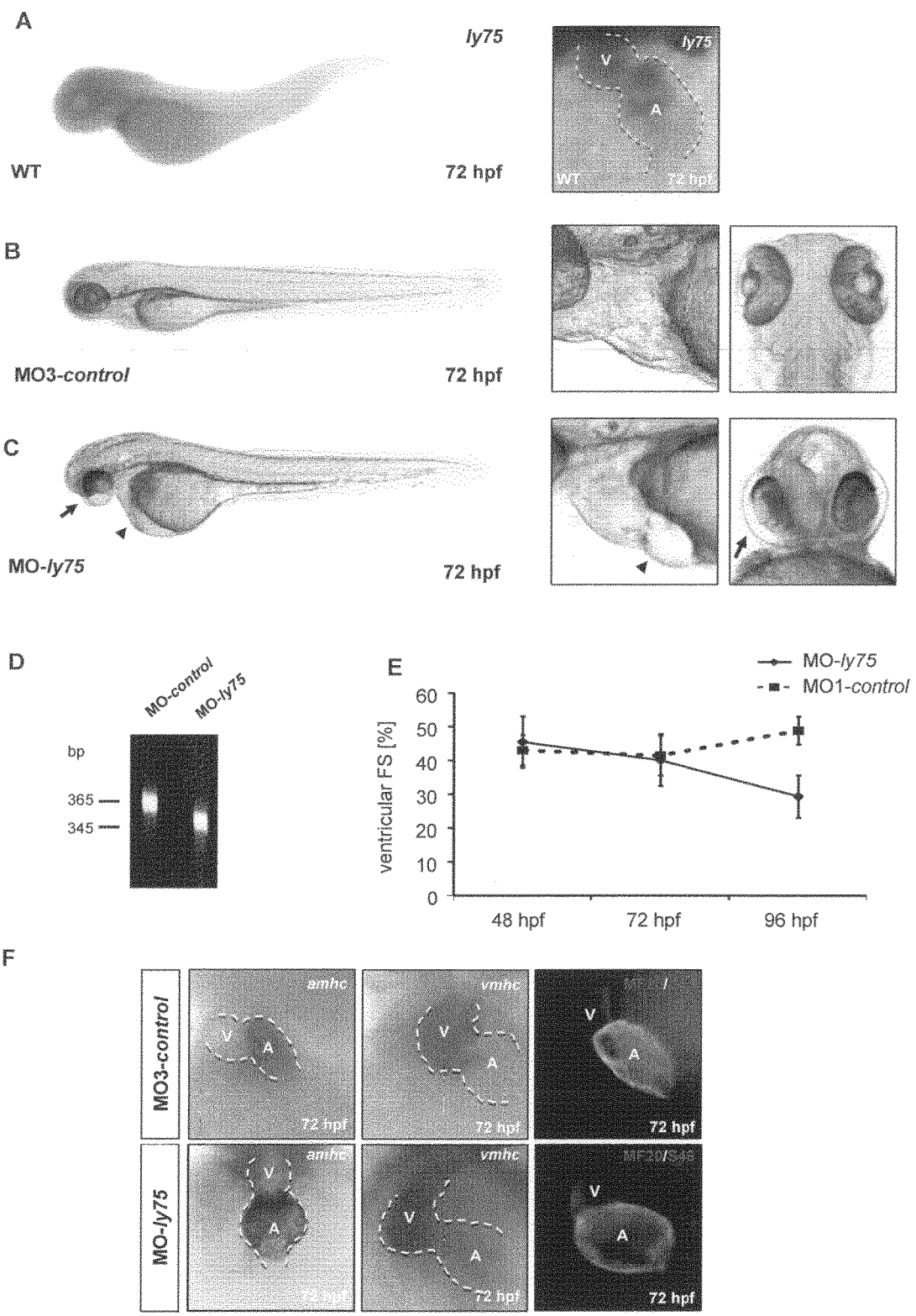

FIG. 8 ly75 is essential to maintain cardiac contractility.

A) mRNA antisense in situ hybridization showing that ly75 is significantly expressed in the zebrafish heart. B, C) Lateral views of MO3-control (B) and MO-ly75 (C) injected embryos at 72 hpf. After depletion of ly75, which can be monitored by cDNA splice-analysis (D), zebrafish hearts show reduced contractile force (E) and precardial blood congestion (arrowhead) as sign of manifest heart failure. Ly75-morphants also show noticeable skin detachment most pronounced in the head/eye region (C).

F) Molecular chamber definition is not impaired in ly75-morphants compared to the control-injected zebrafish as demonstrated by regular amhc, vmhc, MF20, and S46 expression. hpf=hours post fertilization; amhc=atrial myosin heavy-chain; vmhc=ventricular myosin heavy-chain; A=atrium; V=ventricle. Error bars indicating standard deviation.

Figure 9:
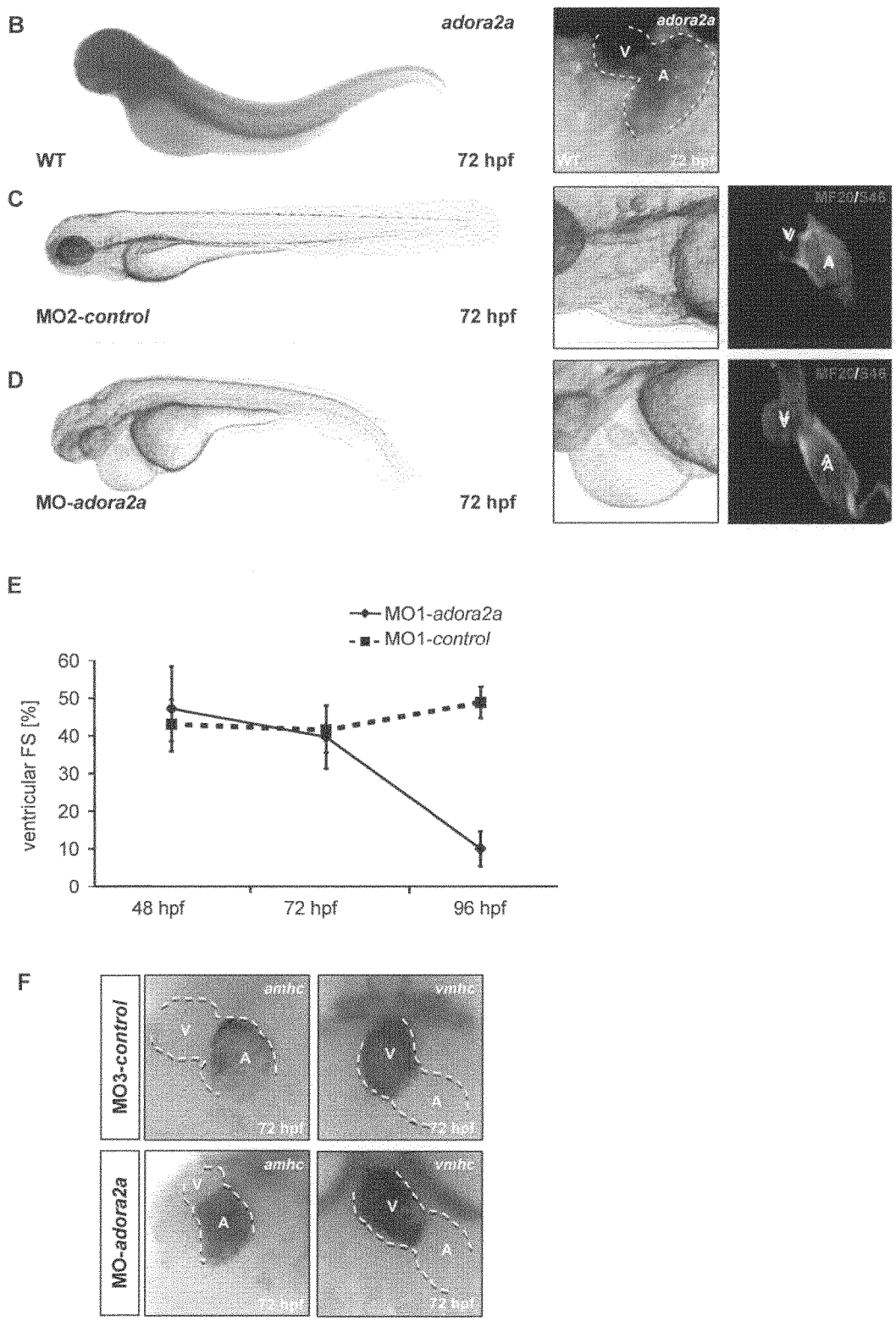

FIG. 9 Loss-of adora2a leads to heart failure in zebrafish.

A) Amino acid sequence alignments of human (h) (SEQ ID NO:98), mouse (m) (SEQ ID NO:99) and zebrafish (z) (SEQ ID NO:100) ADORA2A demonstrating its high cross-species homology. Black boxes indicate amino acid identity, gray boxes indicate amino acids with similar chemical properties. B) Adora2A is significantly expressed in the zebrafish heart. C, D) Lateral view of M02-control (B), and MO-adora2a (C) injected embryos at 72 hpf. After injection of MO-adora2a, 66% of morphant embryos develop progressive heart failure and deterioration in ventricular contractility measured by fractional shortening (E) at the indicated developmental stages. Error bars indicating standard deviation. F) Molecular chamber definition is not impaired in adora2a-morphants compared to the control-injected zebrafish as demonstrated by regular amhc and vmhc expression.

Figure 10:
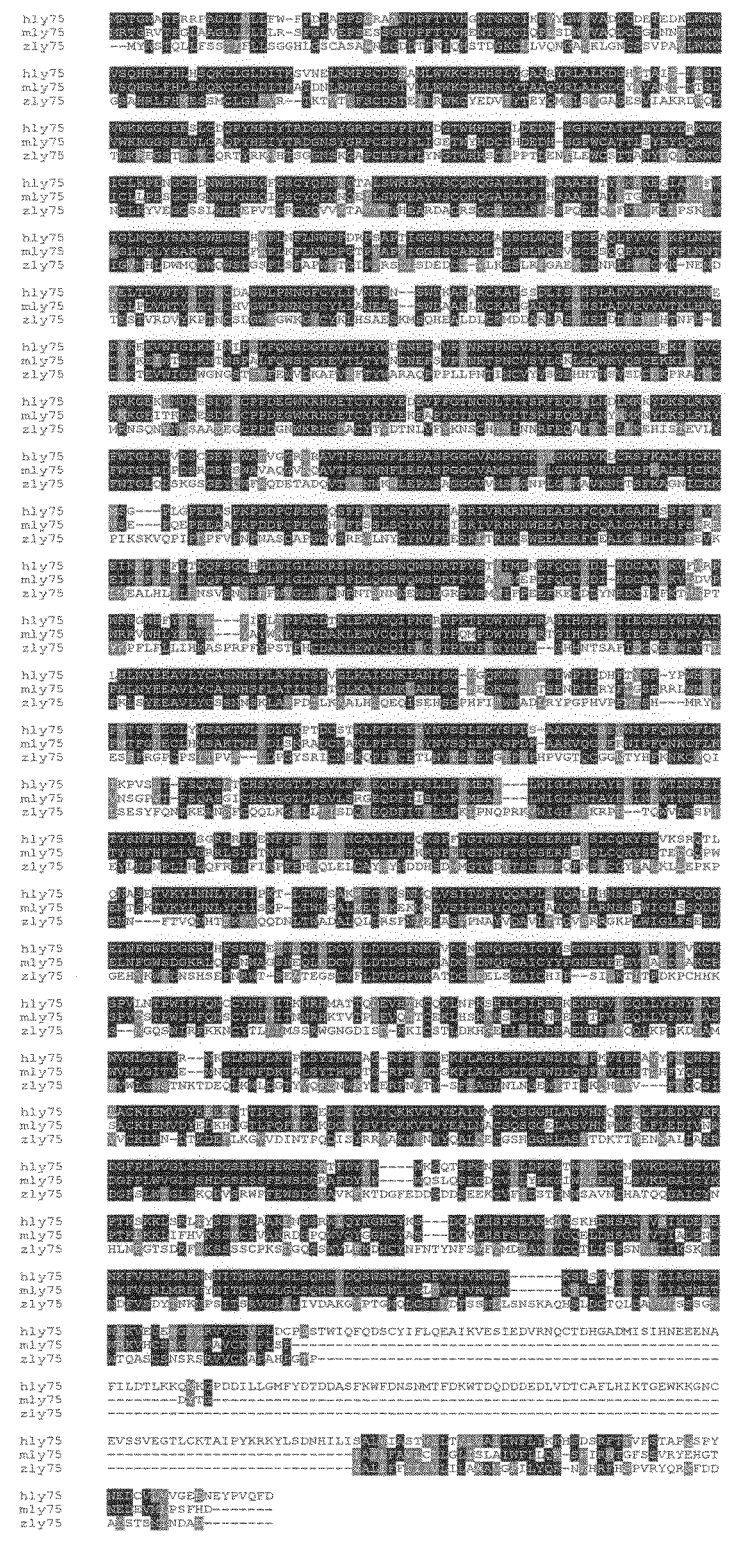

FIG. 10 Protein conservation of LY75.

Amino acid sequence alignments of human (h) (SEQ ID NO:101), mouse (m) (SEQ ID NO:102) and zebrafish (z) (SEQ ID NO:103) LY75 demonstrating its cross-species homology. Black boxes indicate amino acid identity, gray boxes indicate amino acids with similar chemical properties.

EXAMPLES

1. Materials and Methods
1.1 Patients and Controls

The study was conducted in accordance with the principles of the Declaration of Helsinki. All participants of the study have given written informed consent and the study was approved by the ethic committees. DCM was diagnosed according to the guidelines of the World Health Organization (WHO). Inclusion criteria for DCM cases were the presence of reduced left ventricular systolic function (left ventricular ejection fraction <45% assessed by echocardiography) in the absence of relevant coronary artery disease (CAD) as determined by coronary angiography. Patients with valvular or hypertensive heart disease, history of myocarditis, regular alcohol consumption or cardio-toxic chemotherapy were also excluded. The control biopsy specimens were obtained from patients who had received heart transplantation. All patients of the control cohort had successful cardiac transplantation more than 6 months ago with normal systolic and diastolic function and no evidence for relevant vasculopathy as judged by coronary angiography. Furthermore, all controls showed freedom from relevant acute or chronic organ rejection.

1.2 Processing of Left Ventricular Biopsies

Biopsy specimens were obtained from the apical part of the free left ventricular wall (LV) from DCM patients or cardiac transplant patients (controls) undergoing cardiac catheterization using a standardized protocol. Biopsies were washed with NaCl (0.9%) and immediately transferred and stored in liquid nitrogen until DNA or RNA was extracted. DNA was extracted using the DNeasy blood and tissue kit, total RNA using the RNeasy kit according to the manufacturer's protocol (Qiagen, Germany). RNA purity and concentration were determined using the Bioanalyzer 2100 (Agilent Technologies, Berkshire, UK) with a Eukaryote Total RNA Pico assay chip. Since a critical issue for the reliability of gene expression analysis is the quality of the RNA samples, a RNA integrity number (RIN)>6 was defined as minimum requirement for further analyses.

1.3 DNA Methylation Profiling and Fine-Mapping

For measuring methylation profiles, we used the Infinium HumanMethylation 27 BeadChip assay from Illumina with 1000 ng DNA per sample. The procedure followed the manufacturers standard workflow, starting with the bisulfite treatment of the sample DNA leading to a conversion of unmethylated cytosins to uracil, while 5-methylcytosines remain unchanged. After amplification and fragmentation of the bisulfite-converted DNA, they were hybridized to the Infinium BeadChips.

1.4 DNA Methylation Validation by MassARRAY

DNA methylation was validated by the MassARRAY technique as previously described (Ehrich et al., 2005). Briefly, 400-500 ng genomic DNA was chemically modified with sodium bisulfite using the EZ methylation kit (Zymo Research) according to the manufacturer's instructions. The bisulfite-treated DNA was PCR-amplified by primers designed to cover the Infinium probes that showed differential methylation at each locus. The amplicons were transcribed by T7 polymerase, followed by T specific-RNAase-A cleavage. The digested fragments were quantified by MALDI-TOF-based technique. The primer sequences are given in Table 1. DNA methylation standards (0%, 20%, 40%, 60%, 80%, and 100% methylated genomic DNA) were used to confirm the unbiased amplification of the amplicons. For LY75 and ADORA2A we additionally generated 14 and 12 clones, respectively, from 2 patients with DCM and 2 controls, each, and sequenced them before and after treatment with bisulfite. The methylation data was statistically analyzed by Students t-test, or ANOVA, followed by Dunnett's multiple comparison.

TABLE 1

Primer Sequences for mean CpG-island methylation of candidate genes.

| Genes | Forward primers | Reverse primers |
|---|---|---|
| ADORA2A | TTTTTTAGGTGGGTGTTGGTAGTT (SEQ ID NO. 19) | AATTCCCCTAATCCAATAAAATTCC (SEQ ID NO. 20) |
| ATP2C1 | ATTGGATAAAGGTATAGTTGTTAAAAGAAG (SEQ ID NO. 21) | AACAATCACAATCTCAACAAACAAC (SEQ ID NO. 22) |
| CCDC59 | TTTTTAGTGGAAGTAGAGTGGGAAG (SEQ ID NO. 23) | TTAAAACAACCTCCTTACACAATCC (SEQ ID NO. 24) |
| CLDN4 | GTTTATTTATAGGTTTTTTTAGATGGTTTG (SEQ ID NO. 25) | CATCAAAACTAACTTTATCTCCTAACTCA (SEQ ID NO. 26) |
| ERBB3 | GGAGATTTTTTAGTAGAGAATAGGTTTTTT (SEQ ID NO. 27) | TACTACCCAAAACCCTACTAATCCC (SEQ ID NO. 28) |
| FDX1 | TTTGTTTTATAGTGGGTAGAATTTATTT (SEQ ID NO. 29) | AACCTATAAAAACATTAACAAACAAAAC (SEQ ID NO. 30) |
| FLJ20701 | GATTTTAAATTTTAGTGAGGGGTGAA (SEQ ID NO. 31) | TCCAAAACAAAAAATAAACTCCAAA (SEQ ID NO. 32) |
| GFI1 | TTTATTTTAATGAGTAAAGGGTGTAGGT (SEQ ID NO. 33) | CCTAAAATCATACCCAAACACTAAAT (SEQ ID NO. 34) |
| GSTM5 | GGAGGGGGTTTATTGATTTTAGTTT (SEQ ID NO. 35) | TAACTTTCTCTACACCAAACCAACC (SEQ ID NO. 36) |
| HOXB13 | GGTAGTTTTTGGTTTTGGGTTTT (SEQ ID NO. 37) | ACTATCCCTAAATCTCATCTCTCCC (SEQ ID NO. 38) |
| ID4 | AATGGAGTGTTTTTTTATTGGTT (SEQ ID NO. 39) | AATATCCTAATCACTCCCTTC (SEQ ID NO. 40) |
| LY75 | GTATTTTGTTTAGGTTTTTGGGG (SEQ ID NO. 41) | AAAAATCATAAATCCCTTTCCAATC (SEQ ID NO. 42) |
| NAT1 | TTTTTTTAGGAAGTAAAAGGAATGTT (SEQ ID NO. 43) | TCAAACTACCCTAATCTCACTATCCC (SEQ ID NO. 44) |
| PPARGC1A | GATTTTTTAAAAGTTTTTGTTTGG (SEQ ID NO. 45) | ACAAATACCTTCAATTCACTCTCAA (SEQ ID NO. 46) |
| SLC9A6 | GTTTTTGATTGGGTAGGGGT (SEQ ID NO. 47) | AACTTACCATAAATCATAACCAAACC (SEQ ID NO. 48) |
| SULF2 | GAGTTTTGTGAAAGTAGATAAAAGAAAAT (SEQ ID NO. 49) | TAACACACAAACCAAAAAACATC (SEQ ID NO. 50) |
| TDG | TGGTTGGTAGTATTTAGATAGTGGTTG (SEQ ID NO. 51) | ATATACACAACACCCCAAAAACAA (SEQ ID NO. 52) |
| TFF1 | AGGTTGTTAGAGTTGGTTGTGGTT (SEQ ID NO. 53) | AACTTTCTAAATCTCAAATCCCTCAA (SEQ ID NO. 54) |
| TKT | GGGAAGGTTATTATTATTGTTGTTTT (SEQ ID NO. 55) | AAATCCCAAAATTCTACACCCA (SEQ ID NO. 56) |
| XRCC5 | GTTTTTTGTTAGGTTTGAAAGGGG (SEQ ID NO. 57) | AAAAAAAATCTAACTCCAAAACTCTAA (SEQ ID NO. 58) |

The respective target genomic sequences are shown in SEQ ID NOs. 59 to 78:

target genomic sequence of gene

| | |
|---|---|
| ADORA 2A | SEQ ID NO. 59; |
| ATP2C1 | SEQ ID NO. 60; |
| CCDC59 | SEQ ID NO. 61; |
| CLDN4 | SEQ ID NO. 62; |
| ERBB3 | SEQ ID NO. 63; |
| FDX1 | SEQ ID NO. 64; |
| FLJ20701 | SEQ ID NO. 65; |
| GFI1 | SEQ ID NO. 66; |

-continued

| | |
|---|---|
| GSTM5 | SEQ ID NO. 67; |
| HOXB13 | SEQ ID NO. 68; |
| ID4 | SEQ ID NO. 69; |
| LY75 | SEQ ID NO. 70; |
| NAT1 | SEQ ID NO. 71; |
| PPARGC1A | SEQ ID NO. 72; |
| SLC9A6 | SEQ ID NO. 73; |
| SULF2 | SEQ ID NO. 74; |
| TDG | SEQ ID NO. 75; |

-continued

| | |
|---|---|
| TFF1 | SEQ ID NO. 76; |
| TKT | SEQ ID NO. 77; |
| XRCC5 | SEQ ID NO. 78. |

1.5 Promoter Luciferase Assay

To assess the causative link of CGI methylation within the promoter region of LY75 with reduced mRNA expression observed in myocardial tissue, we performed a promoter luciferase assay essentially as described before (Smith et al., 2006). Therefore, we cloned a 1.6 kb large core fragment (Table 2) of the LY75 promoter region including the analyzed CGI into SpeI/BamHI sites of the CpG-free luciferase vector pCpGL-basic. As negative control for the methylation effect we utilized the CpG-free control reporter vector pCpGL-CMV/EF1 (Klug and Rehli, 2006). Next, we treated both vectors with the methylase SssI (New England Bio-Labs) or leaved them untreated, respectively. The methylation was performed at 10 mM Tris, pH7.9, 50 mM NaCl, 10 mM $MgCl_2$, 1 mM DTT and 160 µM SAM at 37° C. for 1 hour (Blesa et al., 2008). Transfection of human HEK293A cells with equal amounts of the SssI-treated or untreated pCpG-LY75 or pCpGL-CMV/EF1 vectors was carried out using Lipofectamin (Invitrogen). Additionally, we co-transfected these cells with the pGL4.74 [hRluc/TK] *Renilla* control vector as a reference (Promega). After 48 hours, cells were lysed and luciferase and *Renilla* activity measured according to manufactures protocol (Dual-Luciferase Reporter Assay System, Promega). Results are expressed as relative luciferase activity (background subtracted and normalized to *Renilla* reference; three technical replicates) of the methylated versus the unmethylated constructs.

TABLE 2

Primer sequences for promoter luciferase assay.

| Gene | Forward primer | Reverse primer |
|---|---|---|
| LY75 | TGGCACTACCCTGAACATCA (SEQ ID NO. 79) | CATGAAATTTCTGGTTCTGCAT (SEQ ID NO. 80) |

The respective target genomic sequence is shown in SEQ ID NO. 81.

1.6 Promoter Region Prediction and Transcription Factor Binding Site Analysis

We applied the Promoter 2.0 Prediction Software that predicts transcription start-sites (TSS) of vertebrate Pol II promoters in genomic DNA to estimate the distance of the CGIs from the potential transcriptional start-sites (Knudsen 1999). For the detection of transcription factor binding sites, the ENCODE transcription factor ChIP-seq data was used. For each region (size of the CGI and 1500 bp up- and downstream), we selected in the maximum the three factors up- and three factors downstream with strongest observed binding.

1.7 Hierarchical Clustering

To generate a graphical representation of the most significantly dys-methylated cardiac genes in the screening stage and to detect patterns among the respective genes, hierarchical clustering was applied. Prior to the clustering, the patients were ranked for each gene according to the degree of methylation, i.e., the patient with the lowest degree of methylation for a certain gene received a rank of 1, while the patient with the highest degree of methylation received a rank of 17, since 17 samples have met filter criteria for the screening stage. Then, for all samples and all genes the pair-wise Euclidian distances were computed and a bottom-up clustering on these distances was carried out. All computations were carried out using the statistical programming language R.

1.8 Gene Network Analysis

To test whether genes with differential methylation patterns belong to a certain biological category we carried out an unweighted Gene Set Enrichment Analysis (GSEA). In detail, we first sorted all genes according to the absolute value of the median distances between DCM patients and controls, generated a sorted list of genes where the most differentially methylated genes were on top while genes without differential methylation were located at the bottom of the list. If one gene was represented by multiple features on the biochip (different methylation sites) the median position of all replicates in the sorted list was computed. This sorted list was then used as input for GeneTrail (Backer et al. 2007). For each category, a significance value is computed by a dynamic programming approach (Keller et al. 2007) and all significance values of a certain category have been adjusted for multiple testing using Benjamini-Hochberg adjustment (Benjamini and Hochberg, 1995). The advantage of the applied cutoff-free biostatistical approach is that genes with p-values of 0.049 and 0.051 are considered to be almost equally important in our approach while genes with larger values in the middle and at the end of the list are considered to be not of relevance. In contrast, classical over-representation analyses relying on cutoffs (usually 0.05) would consider genes with p-value of 0.049 of relevance while genes with p-values of 0.051 would be considered to be non-relevant, having the same impact as genes with large p-values.

1.9 Transcriptomic Analyzes

Quantitative real-time PCR (q-PCR) was performed in order to measure expression of selected genes. Primers were designed using NCBI Primer-Blast and synthesized by Eurofins MWG Operon (Ebersberg, Germany). 60 ng of total RNA extracted from biopsies of independent DCM patients (moderate: n=7; severe: n=5) and controls (n=7) was reverse transcribed using SuperScript III first strand cDNA synthesis kit (Invitrogen). q-PCR was carried out according to standard protocols with the SYBR-Green method (Thermo Scientific) using an ABI 7000 system (ABI). Specificity of each primer-pair was monitored by dissociation curve analysis. Threshold cycle (CT) values were assessed in the exponential phase of amplification and the data were analyzed using the delta-CT method. The mean value of the reference genes GAPDH, RPL13 and â-actin was used as a reference.

To identify the predominant cardiac isoform of ADORA2A, we performed PCR with the following primer-pair for both isoforms (ENST00000337539 and ENST00000541988):

[SEQ ID NO. 82]
5'-CTGTGACATGGAGCAGGAGC-3'
and

[SEQ ID NO. 83]
5'-GCTGTCGTTTGCCATCGGCCT-3'.

To evaluate the expression levels of ly75 and adora2a in the zebrafish heart and whole organism, we performed q-PCR with the following primer-pair for ly75:

```
5'-CATGGCCAGTTTCGATCCAT-3'          [SEQ ID NO. 84]
and
5'-CACCTGGGACTACACCTCCT-3'          [SEQ ID NO. 85]
``` and adora2a:

```
5'-TGCTGACCCAGAGCTCCATA-3'          [SEQ ID NO. 86]
and
5'-AGAGGCATCATCGCGATCTG-3'.         [SEQ ID NO. 87]
```

Results are shown as relative expression values (normalization against the house-keeping gene elf1a).

To analyze the expression of ly75 and adora2a in different cell types, we cultured neonatal rat cardiomyocytes and cardiofibroblasts for 5 days and proceeded as described above. q-PCR was performed using the primer pairs

```
18s RNA
5'-GGACATCTAAGGGCATCAC-3'           [SEQ ID NO. 88]
and
5'-CCTCCGACTTTCGTTCTTGA-3';         [SEQ ID NO. 89]

LY75
5'-CACGGTCTGATGAGCTGTGT-3'          [SEQ ID NO. 90]
and
5'-ACGAACTGCAACCTGACCAT-3';         [SEQ ID NO. 91]

ADORA2A
5'-CTGGTCCTCACGCAGAGTTC-3'          [SEQ ID NO. 92]
and
5'-GCGAAGGGCATCATTGCAAT-3'.         [SEQ ID NO. 93]
```

The methylation data was statistically analyzed by Students t-test.

1.10 Morpholino-Mediated Gene Knock-Down in Zebrafish

The zebrafish experiments were performed under institutional approvals that conform to the Guide for the Care and Use of Laboratory Animals published by The US National Institute of Health (NIH Publication No. 85-23, revised 1996). Care and breeding of zebrafish (*Danio rerio*) were as described (Meder et al. 2011).

The following Morpholino-modified antisense oligonucleotides (GeneTools, USA) were designed:

The ly75 (ENSDARG00000053113) Morpholino targets the splice-donor site of exon 3:

```
MO-ly75:
5'-GTGATGAAACGCACACCTCTCCTGA-3';    [SEQ ID NO. 94]

scrambled control MO3-control:
5'-GTCATGAAAGGCACACGTCTGCTCA-3'),   [SEQ ID NO. 95]
``` while adora2a (ENSDARG00000033706) was targeted at its start-site:

```
MO-adora2a:
5'-CATTGTTCAGCATGGTGAGGTCGCT-3';    [SEQ ID NO. 96]

scrambled control MO2-control:
5'-CATTCTTCACCATCGTGACGTGGCT-3'.    [SEQ ID NO. 97]
```

Morpholinos or control oligonucleotides (MO-control) were injected into 1-cell stage embryos as described before (Meder et al. 2009). To confirm the efficiency of splice-site Morpholinos, we analyzed their target region by cDNA splice-site analysis (Meder et al. 2011).

1.11 Functional Assessment and Statistical Analysis of Cardiac Function

Still images and video films were recorded and digitized with a Zeiss microscope/MCU II. The functional assessment of cardiac contractility was carried out as described before (Meder et al. 2009). Atrial and ventricular diameters were measured to calculate fractional shortening with the help of the zebraFS software (http://www.mederlab.com). Results are expressed as mean±standard deviation. MF20/S46 stainings and mRNA antisense in situ hybridization was performed as described previously (Meder et al. 2009).

2. Results 2.1 DNA Methylation is Altered in Patients with DCM

We performed here a two-staged, funnel-like DNA methylation mapping in non-ischemic, idiopathic DCM patients and controls (Table 3).

TABLE 3

Study sample characteristics of the screening and replication cohorts.

| Cohort | N | Female (%) | Age (years) | LV-EF (%) |
|---|---|---|---|---|
| Screening | | | | |
| DCM cases | 9 | 33 | 57 ± 5.4 | 27 ± 7.5 |
| Controls | 8 | 38 | 42 ± 14 | 60 ± 4 |
| Replication | | | | |
| DCM Cases | 30 | 37 | 58 ± 14 | 25.6 ± 8.4 |
| Controls | 28 | 46 | 57 ± 12 | 61.5 ± 5.3 |

Female = female donor status of transplanted heart;
LV-EF = left ventricular ejection fraction.

Figure 1:
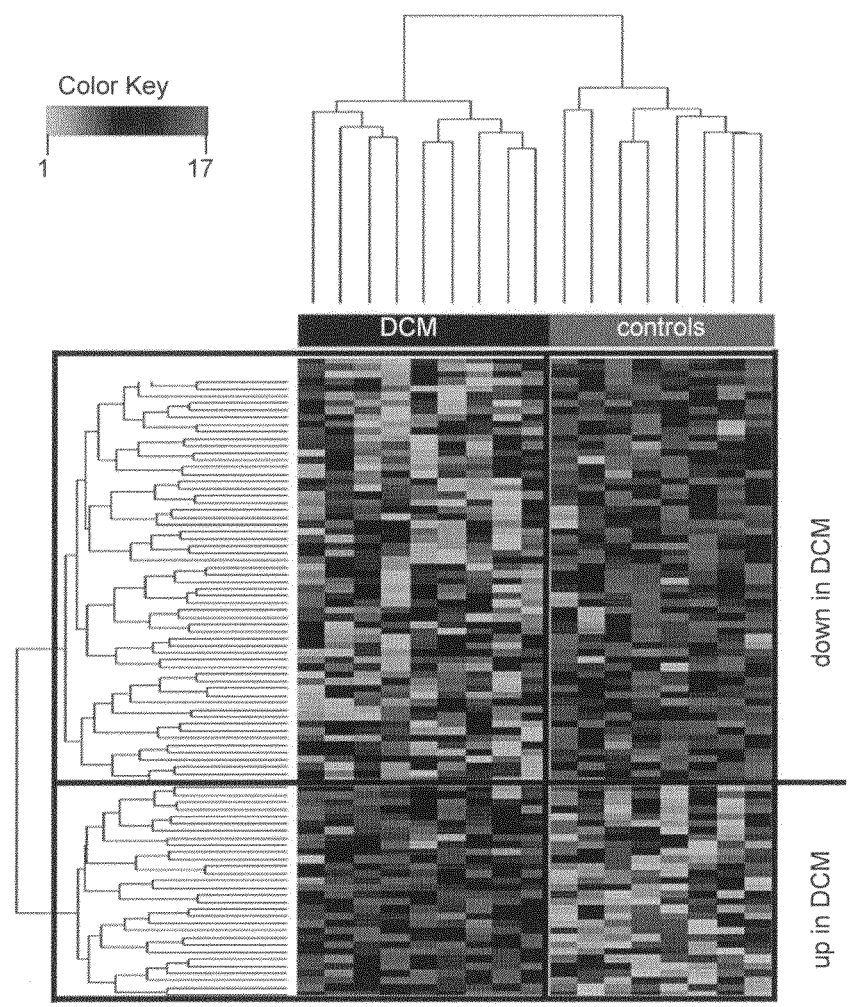
FIG. 1 Detection of DNA methylation patterns.

In the screening stage, we assessed genome-wide DNA methylation levels of CpG islands (CGIs) using the Infinium HumanMethylation 27 platform. To do so, we first extracted 1000 ng of genomic DNA from LV biopsies from 10 DCM patients and 10 controls. After methylation profiling, 17 datasets passed the stringent quality filter criteria, exemplarily shown by reaching highly similar bead color signal intensities (data not shown). FIG. 1A shows a correlation-plot of the 27,578 individual methylation-sites for all further analyzed patients and controls. While the degree of methylation for most CpG sites is highly correlated between the two groups, we detect several CGIs that are hypo- (green dots) or hyper-methylated (red dots) in DCM compared to the controls (unadjusted p-value <0.05).

We used the comprehensive screening datasets in a Gene Set Enrichment Analysis (GSEA) and identified within the top three (ranked by p-values) enriched disease categories provided by the "National Institute of Aging" (NIA) the disease pathways "Cardiovascular Disease", "Metabolic Disease", and "Pathological Conditions", all reasonably associated with DCM and with considerable overlaps between each other (FIG. 1B). To detect patterns of genes with differential methylation in the screening cohorts, we carried out a clustering approach on genes with known abundant expression in the human heart (http://c-it.mpi-bn.mpg.de). From the annotated 2,018 individual genes, 1,858 (92.1%) were covered by the applied Infinium assay. Since the degrees of methylation for the genes were not normally distributed, we used two-tailed Wilcoxon rank-sum test to compute a significance value for each gene, which resulted in a total of 90 genes surpassing statistical significance (p-value <0.05). While about one third showed increased methylation in DCM patients, approximately two thirds were significantly less methylated. FIG. 1C gives a graphical representation of differential methylation patterns by using hierarchical clustering on the Euclidian distance. The heat map shows the patterns of higher- and lower methylated genes in DCM patients and controls.

For the replication stage in an independent cohort, methylation patterns of single genes were used to define candidates for a mass-spectrometry-based fine-mapping. FIGS. 2A and B show the five most hyper- and hypomethylated genes, while C details the 20 most significantly dys-methylated genes of the screening stage. The final selection was based on either unadjusted p-values or absolute methylation difference, CGI localization, capability to design specific assay probes, and known expression in the heart.

2.2 Validation of Aberrant DNA Methylation in DCM

As denoted above, we carried out an independent replication and fine-mapping of the selected genes in a larger cohort of 30 idiopathic DCM patients and 28 controls. The selected candidates were fine-mapped by using MassARRAY (Ehrich et al. 2005).

For each gene, several CpGs were retrieved and their methylation status quantified. From 20 candidate genes, twelve showed the same direction of altered methylation between the screening and the replication stage and four of them reached statistical significance, namely LY75 (p=0.000), ERBB3 (p=0.013), HOXB13 (p=0.001), and ADORA2A (p=0.011). FIG. 3 presents the mean methylation changes of the replicated genes. Additionally, methylation of individual CpGs is displayed for LY75 and ERBB3 (FIG. 3A, B), HOXB13 (FIG. 3C) and ADORA2A (FIG. 3D). Interestingly, ADORA2A showed significantly altered methylation throughout all tested CpGs, while ERBB3 or LY75 showed methylation alterations in a subset of the CpG nucleotides, possibly resulting in different functional consequences. FIG. 4 gives the mean methylation of the rest of the investigated CGIs. Since epigenetic marks may be also dependent on the gender, we additionally matched the gender ratio of cases and controls of the replication cohort to the ratio of the screening cohort, leading to significance of the same CGIs shown above. This is also true when matching females and males 1:1.

In addition to MassARRAY, we also applied bisulfite sequencing for LY75 and ADORA2A to fine-map and again technically replicate our results. To do so, we generated 14 LY75 and 12 ADORA2A clones from two DCM patients and two controls each, and sequenced them before and after treatment with bisulfite (FIG. 3A and FIG. 3D; black circles=methylated CpG, white circles=unmethylated CpG). Bisulfite sequencing confirmed the corresponding MassARRAY data and, hence, demonstrated reliability of the latter technique.

Next, to rule out a potential effect of the immunosuppressive medication received by the control subjects (Table 4) on the methylation of the here investigated genes, we analyzed the methylation patterns of genomic DNA of 11 subjects drawn pre- and post-heart transplantation (HTX) (mean timespan after HTX=37 months under medication). As shown in FIG. 5 we found highly comparable methylation levels (p=n.s.) of LY75, ADORA2A, ERBB3, and HOXB13 CGIs in pre- and post-HTX, indicating that the observed methylation differences in DCM is not due to methylation changes in the controls receiving immunosuppressive medication.

TABLE 4

Immunosuppressive medication of control individuals.

| Medication | N | % |
| --- | --- | --- |
| Tacrolimus | 19 | 54 |
| Mycophenolat- | 23 | 66 |
| Ciclosporin | 8 | 23 |
| Prednisolon | 11 | 31 |
| Everolimus | 14 | 40 |

All control individuals received one or more immunosuppressives.

2.3 Differential Gene Expression and Functional Evaluation In Vivo Points Towards a Functional Role of Altered DNA Methylation in DCM DNA methylation is often correlated with changes in the accessibility of DNA to transcriptional activators, enhancers, or repressors. Hence, we first studied the impact of DNA methylation at LY75, ERBB3, HOXB13, and ADORA2A loci on their gene expression by quantitative PCR (q-PCR) in controls, mild DCM (NYHA class II) and moderate to severe DCM (NYHA class III-IV).

For ADORA2A, we found a positive relationship of gene expression with methylation (relative expression=0.33; p=0.002), while ERBB3 did not show significant alterations in cardiac expression levels (FIG. 6B, C, D). HOXB13 transcripts could not be PCR amplified in LV biopsies from both, patients and controls. In case of LY75, the hypermethylated CpG island is relatively close to the transcriptional start-site (distance 1,395 bp), whereas the distance between the CGIs in ERBB3 (7,518 bp) and ADORA2A (14,329 bp) is markedly larger (FIG. 3). Since we observed also a strong reduction in LY75 expression in myocardial tissue (relative expression=0.04; p=0.001) in patients with DCM (FIG. 6A, D), we asked if increased promoter methylation is directly responsible for decreased transcriptional activity. Hence, we performed a luciferase promoter assay with methylated and unmethylated LY75 promoters. As a negative control served the CpG-free control reporter vector pCpGL-CMV/EF1. As shown in FIG. 6E, we found a strong reduction in promoter activity after in vitro methylation, supporting the functional relationship between LY75 hypermethylation and reduced expression in human DCM.

Since we found a rather unusual positive relationship of ADORA2A gene expression and methylation, we first sought to identify the predominant isoform of ADORA2A in the human myocardium. By PCR, we found that the longer ADORA2A transcripts ENST00000337539 and ENST00000541988 are highly expressed in the heart. However isoform ENST00000417596, which is highly expressed in peripheral blood, is not significantly expressed in the heart. We then investigated potential repressor regions in the close vicinity of the tested CGIs. For the detection of transcription factor binding sites, the ENCODE transcription factor ChIP-seq data was used. We found for the aberrantly methylated CGI-1 two potential repressor sites (CTCF and NFKB), for aberrantly methylated CGI-2 one repressor site (CTCF) and for the unaltered CGI-3 one repressor site (Max). Interestingly, both hypomethylated CGIs (1 and 2) carry CTCF binding sites, which were recently identified as epigenetic key regulators in various other diseases.

Since LY75 and ADORA2A were not previously known to be involved in DCM or heart failure pathogenesis and both showed significant downregulation in the myocardium of DCM patients, we investigated their functional roles by gene knockdown in zebrafish embryos (Dahme et al., 2009). We identified orthologous sequences for human LY75 and ADORA2A by BLAST searches against the zebrafish Genbank database. Protein sequence identity between the zebrafish and human version was 61% for adora2a (FIG. 9A) and 37% for ly75 (FIG. 10). Similar to the human situation, we found adora2a and ly75 to be highly expressed in the zebrafish heart using q-PCR and RNA antisense in-situ hybridization (FIGS. 7, 8 and 9). Additionally, as shown in cultured neonatal rat cells, both genes are higher expressed in cardiomyocytes than in cardiofibroblasts (FIG. 7B, C). Hence, to recapitulate the downregulation of both genes as observed in the human heart, we inactivated them in zebrafish embryos by injection of Morpholino-modified antisense oligonucleotides directed against the splice donor-site of ly75 or the translational start-site of adora2a. While control-injected zebrafish (standard control Morpholino as well as scrambled control Morpholinos) embryos did not show any obvious phenotype, splice-site Morpholino-mediated knockdown of ly75 resulted in partial skipping of exon 8 (FIG. 8D) and consecutive frameshift that predictably leads to a premature stop of protein translation. As a result, ly75-morphants developed "late-onset" heart failure with dilation of the atrium (FIG. 8C) and reduced ventricular contractility beginning at the 96 hours developmental stage (FS=46±5% at 48 hpf and 29±4% at 96 hpf) (FIG. 8E). Additionally, ly75-morphants showed a pronounced detachment and edema of the skin especially noticeable in the eye and head region (FIG. 8C). MO-adora2a injected embryos also developed severe heart failure with progressively decreasing ventricular contractility as measured by fractional shortening (FIG. 9E). In detail, the ventricular contractility of adora2a-morphants decreased from 47±11% at 48 hpf to 39±8% at 72 hpf. By 96 hpf, both heart chambers became almost silent. Occasionally, we also observed atrial fibrillation in adora2a-morphants and embryos developed excessive pericardial effusion and precardial blood congestion as consequence of the reduced cardiac function. For both, ly75- and adora2a-morphants, we saw no alterations in the molecular chamber specification and expression of atrial and ventricular myosin heavy chain genes (FIGS. 8 and 9).

For investigating the functional role of ERBB3, we also used the zebrafish as animal model. We find homology of 56% between human and zebrafish orthologues sequence of ERBB3. Knock-down of erbb3b results in a similar, but earlier phenotype as adora2a. Already by 72 hpf, 86% of injected erbb3b-morphants suffer from significantly reduced cardiac contractility, reduced blood flow through the atrium and ventricle, and pericardial effusion (data not shown). FS at 96 hpf is reduced to 21±4% and blood aggregates at the cardiac inflow tract (data not shown). Additionally, erbb3b-morphants show regurgitation of blood into the ventricle (data not shown), suggesting impaired cardiac valve development. cDNA splice-site analysis revealed a completely insertion of intron 2 as well a partial exclusion exon 2 producing an aberrant, frameshifted transcripts with premature termination codons.

The features disclosed in the foregoing description, in the claims and/or in the accompanying drawings may, both separately and in any combination thereof, be material for realizing the invention in diverse forms thereof

REFERENCES

Backes C, Keller A, Kuentzer J, Kneissl B, Comtesse N, Elnakady Y A, Muller R, Meese E, Lenhof H P. GeneTrail—advanced gene set enrichment analysis. *Nucleic Acids Res* 2007; 35(Web Server issue):W186-92.

Backs J, Song K, Bezprozvannaya S, Chang S, Olson E N. CaM kinase II selectively signals to histone deacetylase 4 during cardiomyocyte hypertrophy. *J Clin Invest* 2006; 116(7):1853-64.

Backs J, Backs T, Bezprozvannaya S, McKinsey T A, Olson E N. Histone deacetylase 5 acquires calcium/calmodulin-dependent kinase II responsiveness by oligomerization with histone deacetylase 4. *Mol Cell Biol* 2008; 28(10): 3437-45.

Bell, A. C., A. G. West, and G. Felsenfeld, *The protein CTCF is required for the enhancer blocking activity of vertebrate insulators.* Cell, 1999. 98(3): p. 387-96.

Bell, A. C. and G. Felsenfeld, *Methylation of a CTCF-dependent boundary controls imprinted expression of the Igf2 gene.* Nature, 2000. 405(6785): p. 482-5.

Benjamini Y, Hochberg Y. Controlling the false discovery rate: A practical and powerful approach to multiple testing. *J R Statist Soc B* 1995; 57:289-300.

Bielecka-Dabrowa et al., New methods in laboratory diagnostics of dilated cardiomyopathy. *Cardiol J.* 2008; 15(4): 388-95

Blesa, J. R., A. A. Hegde, and J. Hernandez-Yago, *In vitro methylation of nuclear respiratory factor-2 binding sites suppresses the promoter activity of the human TOMM70 gene.* Gene, 2008. 427(1-2): p. 58-64.

Coppede F. Epigenetic biomarkers of colorectal cancer: focus on DNA methylation. *Cancer Lett* 2011.

Dahme, T., H. A. Katus, and W. Rottbauer, *Fishing for the genetic basis of cardiovascular disease.* Dis Model Mech, 2009. 2(1-2): p. 18-22.

Ehrich M, Nelson M R, Stanssens P, Zabeau M, Liloglou T, Xinarianos G, Cantor C R, Field J K, van den Boom D. Quantitative high-throughput analysis of DNA methylation patterns by base-specific cleavage and mass spectrometry. *Proc Natl Acad Sci USA* 2005; 102(44):15785-90.

Erickson S L, O'Shea K S, Ghaboosi N, Loverro L, Frantz G, Bauer M, Lu L H, Moore M W. ErbB3 is required for normal cerebellar and cardiac development: a comparison with ErB2- and heregulin-deficient mice. *Development.* 1997 December; 124(24):4999-5011.

Feinberg A P, Tycko B. The history of cancer epigenetics. *Nat Rev Cancer* 2004; 4(2):143-53.

Friedrichs F, Zugck C, Rauch G J, Ivandic B, Weichenhan D, Muller-Bardorff M, Meder B, El Mokhtari N E, Regitz-Zagrosek V, Hetzer R, Schafer A, Schreiber S, Chen J, Neuhaus I, Ji R, Siemers N O, Frey N, Rottbauer W, Katus H A, Stoll M. HBEGF, SRA1, and IK: Three cosegregating genes as determinants of cardiomyopathy. *Genome Res* 2009; 19(3):395-403.

Gaszner, M. and G. Felsenfeld, *Insulators: exploiting transcriptional and epigenetic mechanisms.* Nat Rev Genet, 2006. 7(9): p. 703-13.

Giridhar P V, Funk H M, Gallo C A, Porollo A, Mercer C A, Plas D R, Drew A F. Interleukin-6 receptor enhances early colonization of the murine omentum by upregulation of a mannose family receptor, LY75, in ovarian tumor cells. *Clin Exp Metastasis* 2011; 28(8):887-97.

Grzeskowiak, R., et al., *Expression profiling of human idiopathic dilated cardiomyopathy.* Cardiovasc Res, 2003. 59(2): p. 400-11.

Hamad E A, Li X, Song J, Zhang X Q, Myers V, Funakoshi H, Zhang J, Wang J, Li J, Swope D, Madonick A, Farber J, Radice G L, Cheung J Y, Chan T O, Feldman A M. Effects of cardiac-restricted overexpression of the A(2A)

adenosine receptor on adriamycin-induced cardiotoxicity. *Am J Physiol Heart Circ Physiol* 2010; 298(6):H1738-47.

Herceg Z, Vaissiere T. Epigenetic mechanisms and cancer: an interface between the environment and the genome. *Epigenetics* 2011; 6(7):804-19.

Jirtle R L, Skinner M K. Environmental epigenomics and disease susceptibility. *Nat Rev Genet* 2007; 8(4):253-62.

Jones P A, Baylin S B. The fundamental role of epigenetic events in cancer. *Nat Rev Genet* 2002; 3(6):415-28.

Keller A, Backes C, Lenhof H P. Computation of significance scores of unweighted Gene Set Enrichment Analyses. *BMC Bioinformatics* 2007; 8:290.

Klug, M. and M. Rehli, *Functional analysis of promoter CpG methylation using a CpG-free luciferase reporter vector*. Epigenetics, 2006. 1(3): p. 127-30.

Knudsen, S., *Promoter2.0: for the recognition of PolII promoter sequences*. Bioinformatics, 1999. 15(5): p. 356-61.

Litzow M R. Novel therapeutic approaches for acute lymphoblastic leukemia. *Hematol Oncol Clin North Am* 2011; 25(6):1303-17.

Meder B, Laufer C, Hassel D, Just S, Marquart S, Vogel B, Hess A, Fishman M C, Katus H A, Rottbauer W. A single serine in the carboxyl terminus of cardiac essential myosin light chain-1 controls cardiomyocyte contractility in vivo. *Circ Res* 2009; 104(5):650-9.

Meder B, Huttner I G, Sedaghat-Hamedani F, Just S, Dahme T, Frese K S, Vogel B, Kohler D, Kloos W, Rudloff J, Marquart S, Katus H A, Rottbauer W. PINCH proteins regulate cardiac contractility by modulating integrin-linked kinase-protein kinase B signaling. *Mol Cell Biol* 2011; 31(10:3424-35.

Meurs K M, Kuan M. Differential methylation of CpG sites in two isoforms of myosin binding protein C, an important hypertrophic cardiomyopathy gene. *Environ Mol Mutagen* 2011; 52(2):161-4.

Montgomery R L, Davis C A, Potthoff M J, Haberland M, Fielitz J, Qi X, Hill J A, Richardson J A, Olson E N. Histone deacetylases 1 and 2 redundantly regulate cardiac morphogenesis, growth, and contractility. *Genes Dev* 2007; 21(14):1790-802.

Movassagh M, Choy M K, Knowles D A, Cordeddu L, Haider S, Down T, Siggens L, Vujic A, Simeoni I, Penkett C, Goddard M, Lio P, Bennett M R, Foo R S. Distinct epigenomic features in end-stage failing human hearts. *Circulation* 2011; 124(22):2411-22.

Smith, L. T., et al., *Epigenetic regulation of the tumor suppressor gene TCF21 on 6q23-q24 in lung and head and neck cancer*. Proc Natl Acad Sci USA, 2006. 103(4): p. 982-7.

Sommerschild H T, Kirkeboen K A. Adenosine and cardioprotection during ischaemia and reperfusion—an overview. *Acta Anaesthesiol Scand* 2000; 44(9):1038-55.

Takai D, Jones P A. Comprehensive analysis of CpG islands in human chromosomes 21 and 22. *Proc Natl Acad Sci USA* 2002; 99(6):3740-5.

Talens, R. P., et al., *Variation, patterns, and temporal stability of DNA methylation: considerations for epigenetic epidemiology*. Faseb J, 2010. 24(9): p. 3135-44.

Timonen P, Magga J, Risteli J, Punnonen K, Vanninen E, Turpeinen A, Tuomainen P, Kuusisto J, Vuolteenaho O, Peuhkurinen K. Cytokines, interstitial collagen and ventricular remodelling in dilated cardiomyopathy. *Int J Cardiol* 2008; 124(3):293-300.

Urmaliya V B, Church J E, Coupar I M, Rose'Meyer R B, Pouton C W, White P J. Cardioprotection induced by adenosine A1 receptor agonists in a cardiac cell ischemia model involves cooperative activation of adenosine A2A and A2B receptors by endogenous adenosine. *J Cardiovasc Pharmacol* 2009; 53(5):424-33.

Villard E, Perret C, Gary F, Proust C, Dilanian G, Hengstenberg C, Ruppert V, Arbustini E, Wichter T, Germain M, Dubourg O, Tavazzi L, Aumont M C, Degroote P, Fauchier L, Trochu J N, Gibelin P, Aupetit J F, Stark K, Erdmann J, Hetzer R, Roberts A M, Barton P J, Regitz-Zagrosek V, Aslam U, Duboscq-Bidot L, Meyborg M, Maisch B, Madeira H, Waldenstrom A, Galve E, Cleland J G, Dorent R, Roizes G, Zeller T, Blankenberg S, Goodall A H, Cook S, Tregouet D A, Tiret L, Isnard R, Komajda M, Charron P, Cambien F. A genome-wide association study identifies two loci associated with heart failure due to dilated cardiomyopathy. *Eur Heart J* 2011.

Zhang X, Yazaki J, Sundaresan A, Cokus S, Chan S W, Chen H, Henderson I R, Shinn P, Pellegrini M, Jacobsen S E, Ecker J R. Genome-wide high-resolution mapping and functional analysis of DNA methylation in *arabidopsis*. *Cell* 2006; 126(6):1189-201.

SEQUENCE LISTING (103 sequences)

SEQ ID NO: 1 - DNA, 24482 bp, Homo sapiens
gtttatttattttttctttttttttttttggtagaaatgggcttttcgccatgttgcccaagctggtcttgcacttctgggctgaagcaatcctctcgccttggcctcccagagccttgggattacaggtgtgagtcactacagtgattgtgaatgcactgagctggcctggagaacacttaccaccttgtccacgtcacatgcaaaaggcccatggtggtggtgcttcctgcacacgagggcatgtagtgaatgcccttcccaggtggagactcctcagggttgggagcccagcaactgccttggccctgagtaagccaggagttgcactgtgacctgcaagtgcttgggagctgcacccctgggtgccaacagctgcaggtaccctggggtgggcagtgggcaacagctgtagagctgggagctgggcgtgaaaggactggggcaggactgggcttggactcagctcctccctgctcagcagccccttcgttgtgtcctctgctgtgcggaaggggttctgccctagtggtcagcaagcatccatggagcctgccgggcgggccctgtgtgcagcggcctccacacgtcagcaggggactgccgtccctgccagcgcacctgggccttgtcctgggcagcacagaccccttagccaccactcccaggtggggcggtcactcccagatcctccatccgtcccgcctgcagtgcagctgccttggatgctgattagggtggccctgaggggatccttctgtcccaagttacgggcctgcggggcccgtccacagtgctgtgcccctcaatttggagctggctctgctgcttcccagggcagcacctatggggagggcatcgtttataccttgactcaaagttccaggatctcagggacagcttaataggtggaagggggaagctgtgagattccagggagagtggagagattccagggagagtggagagattccagaaggatcccttacacccctccagcaccctcaagggcctgcggtcctgtgcccagacgccacgccctgccccagcagccctgcctggccagctctatggccccagccccacggggccggcacttcgtgcaacctcggggtagcctgggttctattttaggttgtcccttaggtgagggaccggggcagacagaaccagtctcaacatgctcgcagccacttccccgtacatcaggtgagtgaggacagactcctgggttgctgagattcggggatctggattctggcaggagctttgaccccaacaggtctggaccttactgggcatctacaggagctgggccgggcacaagagaggactccatctctcctgcctgacaggagaggactccacctgaccagccctctcaggctgggagtgcctcggggagcctgctgtgaggcagggggaggggtgcggagagaccgggcacagcttgccagttgactgcaccaggcccagagcaggtgctgaaaggtctggtcttttgtctgcaccctcccgtgtttgtgaggaaggggtggcagggggtctgcagtcttaagggccaagcagaaaagaagggccaaggcaggcacccaccaggcaggaagcaggtgtgccctgaggggaaggacaggccatcgcagggctgggttgcacccaagacttctgccaggaagagcactgaggagtcgggacacacaggtcctccccaggtcagccaccgacacttgggatgtgctgggcttgtttccacctctgcaaagcagggcccccttctgggccctcatatcaggcactctgacatggggtacagtcctggcaggtcatggggctggggccacagggagagcgggcaggtggcttagagccatcggggtgatgagtggcaagccccggcatgagggctgcagaggactgtcactgcccacgctggagccagggctccactcccctcagggcctgctttcacatctacgccgatcatccccaaggccgggttgctagcgggttgctgtttgtcctgacacccagaagcagatatggggtgaacatcttgagtggggtggggtgagttggaggatgatgaccagtgactcggagatcacttcctccgtatgtttcttctgcctttgcaggacctctgttaggataaactggagccttgtgaggtccctgccccattggagaagttggggagcacccagggtgacccagttggtttccagggacccttcccctgctcactggctgcttgtcctgggcctggcatgtcttgctcctgatgcagctcagctggcctcagagcaaacaatgagggccagaggccaccaggtgcatcctgggcaggaacaaagggccggaatcctggagctggggaggcccagctggccccgccgccgccgggcctgaggatctggagcctggatggaaggaagggtgggcgcccacagccttttcaaagcctgcctggggctgggcagggaaaccaacgcctggagccagaagctggggcctgccaggggcctccccgtgcccaccaaagggcagtggttgcaattggagagcttctgcccctcagccttgttgctcccttgggcctgggggtgggggaggcgggcagcccaggcacctgcacagggacctcccccagccccacagccttggtatctgaggacagcactcagctgaggtgggtacggggctggcaagggggcagcaaggccaagactgaggaggtggccttaaggcacgtggtgccgagaacacaggcccctccctggagaagacaagctggcttgtggggcaggcagtttggggacagccctgccaggtgccgttccccatccctgaactggacagcttggcctgtgccgtctctgggcaatggcagcgctggagacctgggccaaagcacctgacagatgacacaggaccgcggggctctctgcctctgaagggccagggaggagcccagtaggggaagggtgggggcctggcctgagccggcccatcacagcctccttggcactggctcctcatgggtggctgtggggactgtggagctggctctggggctggagccactccaggccctgcctgaccaccccctggcctcaggacacagttccaccggcgccactgctgaggaatggaggaactgccccttgagccctagaggtgaatgttaagggctttggcactgtgaccctgaggaccagctttggaacaaagccatcactccctgcgtgaggacgttgcggctgcaaccctcctgctgtgggactggggtgcacatggctagaccatgcatgggaaggtccacgcaggaaggttgcgggccccaggatgggaatggcagaggagtcattggggtccacactgggggacgagacagaccctcagaatcggctgagggctggtttctgcctcgtgagccccctgagcccctcaggaagactcaggacgctccgtgcatgtttgctgagtaagggcttgaatgaatctgggtccagcaggtgtgggcgggaggggtttgtccccactagaggagaggttttacctcgtggagagccccagaagcaaggatgggggggccaaggatggggccaagggagggccccatggccgtcagcatccctcacccctaccttgtggtttgacttaacctccaggagggggcagggcagacacaagatactcattttacaggtgaggatatgggtcctggaaggtctgcagggaagcccctgccgctggtcccagggcggtgtccccacctggagggggagctcctccactgaggaaagccagggccatgggagaaggcgagctcctttgaatagagggtcagcaaaggccaggatgacagagaggggggcaccagggccaggtctccttggaaagacctggggacagcgccccaagagtctcatgtgggtctcgcccttcggagtttaactcaagctgtctaggtccccacacatcccagggtttcctcctccaccttggacattagggaacacaaggaccaggagagccgggctagttgaatgggaacgggggcccaggcttcgatcccaggaataagccagggaggctgccagatgctcaaggctgcatctgggtaagcaatggtcactgccatgggccccatgcttctcctaacacactggccaggtgcctgtgtgcccatttcccacccaccctctcctccctgcagtgagtggtagctgctgtgatagaggtcatgcccccattctgccttcagccttagggtccagcctggccctgggcaagcccctccaccctgggcctctagccaggaccccactggtccccagaggttctagaatgcaaggattcccaaaagcctttggccaccaatgccccggctgtctgacatagcctgtcctgtcgtgaacagttgggattagtccacatccctccagatgcaagggtagaaggcgggtccccttggacagcttggagggctggacatgaagttgttcccagttggaagtctccagaaaataggcgagtggggcggggggatggggggggaattcccagcctcaggctctaaaattcccagttagtctgtggtgcagacaggactccctgcctccttgttcagggaagtaggggaggatcaaggccacactgggcaccaggagctggaagaacaagagggtctctggcccagagtctgggatggggagaggcagagggggcattggaaattggggacacatctttgaactgagataacagctgttgccaagaccagcacctgggccaggctaaggaagggcagggctaaaggtgggggagctaagggtcaggcagggccttgaacgccgtgttcaggaggctggcctttatccctcaggacctggggagccatggaaagatctgaggagcaggcattgggcacagctggacactggggaacgggtgacacaggggcatggatccagcccaactctgataaggaacagcagagttccacaggaccatagtggcagaggcagcagtgaggacttcttttttatttatttgtttgtttgagacagagtctagctctgtcccccaggctgcagtgcagtggcgtgatctcagctcactgcaacctccgcctcccgggttcaagcgattctcctgcctcagcctcccgagtagctgggactacaggcgcatgccaccacgcccggctaaattttgtacttttttagtagagacagggttttaccttgttagccaggatggtctcaatctcctgacctcgtggtccgcccacctccgcctcccaaagtgctgggattacaggcgtgagccaccgcgcccggccggcaatgggggcttcttaaaaaagagggaggctgggcccggtggttcacgcctgtaatcccagcactttgggaggccgaggcgggcggatcacgaggtcaggagttcgagaccagcctgaccaacatggtgaaacaccgtctctactaaaaaatacaaaagttagccgggcgtggtggcgggcgcctgtaatcccagctactcgggaggctgaggcaggagaatcgcttgaacccgggaggtggaggttgcagtgagccgagatcgcgccactgcactccagcctgggcgaaagaccaagagtccgtctcaaaaaaagaaaagagggagtgtgggggtggggcccggagcgctccaaggggcggggaaggggactcccaggcccgaggactcctggaagggaggtgagtgtggcgctgaggaagcggcgggacggatgcgagcccgggaggagcgcgctggggggccgcaggcgggggatgtggcgcggtccaggcccgtcgcggcctcgtcctgacagggacacctgcgggatcgtccttccaggatcgcctgcgggcctcgcgggccgatgcctcgggtccccctccggcctcggtttctccgcgcagcggggcggggcgggggcagcgcgggtctcaaagctgcctgcagggggcgcccgtgagcggcgcggccggagccggagacccagcggccgccgagacagcgggagccggcgtgcgagcggcaggtcagccggggtgctaggtctggcgtgcggggtcctgggtgccgggtccggggtgcggggtgccgggggtccggggctggtggccgggcggcgtggggccgtcgggggtgcggggccgggaggactgggaggctggggttctgctcccctcagggttcctttcccgccgccccgagaccagttccccggcgcggggtccgagtcctgccccgcggcggctgccggcactgcctgtgaagggcccaggcacagtcacgtcccaggcgcagttgcggcgccgcgtgcgggaccctccgagctgtcccaaactgcaccggaaggcgcgcaggggtaggcggggagggaaggcaagtgcggcggccggcgcggcgcggggtgcggagccgcaggtagcgggcggggagcgtccgtccgtcagtccgtccgtccgtccatgcgccgcagaccggccccgcgcgctcgcatgaaccttcgcgagctcctccagcagggatggaccgggggcgcagaggcgcttcctgaggggtggcgggccgggccccggggcgagggagattccccaggtggaggagccgggcggagaccggttccccgggaaggtgaggcgcgggcagagatacccgagcgcccgggacgcgccgagaaagggggaatcaggaacgctgggccgagcgctggcgtcttccgtggacagtggtggcgggaactgggtttgggggacccaggagacgacgggggacggatgggggtgggtgcgcgcctcggactggccccggccgtctgtctggctgcccggagcggaggtaggaatggcgggaatggtggcggctctcgagggatttggcgcaaggcggcccaagggcttgaggaggaggccgcgggccggcagagctgaggtccctgtgtcccgcactcagactttagttgccccgactgtaccatgggaggaagagggagacccagggctgggtcctaggctgggggagtcggggccctgcaaagacgcgcaggtgtttgtggcccttgttggagggtgagccgcaggtcaagccagccctccgtcgccatcctgaagcacctcctctcttgggctctgccacacacagggccttctcccctattgccaggtgctcaggccgcctccaccctgcctctgctgccggctccccctgggttccccggcggggcaccctgccgatactccatgacgcgccagggctgccccagggtgccccagccctggggaccatggtggagggttctgtggagcaccgcgggcctgggaagctgttgcggggtcggggcttcctcactggccctgctttggccgttcctggaggccttgggtggggctgggaaggccgggccctgtgggcagcaccccccccccccccgcccaacatcccggcagatccatggcaggggcgcctcacaggctggtccacggccacggtgtcagtccctccttgttctgcgcttgctttttggggtctcccagcctctccctagtcctagagtttctcaggcaaatcccagccactacccctccatccgtgtcccctgtttccccagtgctgagctggctgagctgtgagctttcctgctccttgcctcaggaagccaggggcagcccagtcacctctggccagaggcgggccttaggccaaggctgacctggctggtctgagagctgtgctgggcttcttcccatatcagtctgtgaattacagatccccaaatatgccctgcgtcgcgatggaggagggcaatcaatggcaatgactgcctcatgggcaacgcgatgtgctggagatttcagtgctctcgtctgggttctggtcttgcctcctcgacccactcgctgagcaggttgctgtcccggggaatctgatatctcatctgtagaacaaggatgatgatcttagcaatgcctaatgtggaaaggccttggcttgggagcaagtgggggaaggtttagggcagaccagagggccggtgaggggtgtgtgctggagcggggaacccgggagggagggtgttaggcttgagggtcaggggacaccacagggattgctgttggcagagggacatatgaatggtagttggcctgggagccagcatgtgacttgagagcatcacgtcctgcaaagtccaggtgaggcctgggcagtgcctgctgtgtgggaccacagcccctggtggctctcagctgtgtcctgacactccaaagaaggtcttagtaccctctcacagacctaatacccgagccacctaaccccaaatgagctagaactgccttcccaaccgtgtttgcggggtctgtcttgtctattgcagcgcaaacagagccctgagcacgcaggagagcagaggaaggacagacagaagatggatggatggatgaaggcgggaagcacaggctgaggggatttagggcatgtgtggtgggggtgctgtggagaggagactgcacaggcaggagctgagctggtgaatgggagggttctagctcccagaagggtctgggccattgacaggaggggcttggtcctaggaggtgggtggtccagaggttgcaaggagcagaggagcccagatggggaagggaatggagctggggtgcagagaggagcccccacacaactgcccacatcctgtgcagaacctggggctctgggtggtgggaagaggcagtttcatggcggaggaggcctgggcccctgcagcctggactccatggatctggccagggactggggaggatcaggtggagagaggagcagcagagcagctgcccctcgtcccagcacaggggatgatgggagcccagggaaggcaggaccctggcttcgggcattttctctgctagaatctctcgatacctctctcccttcaccttctcctccaagtctcacccagatgatgtttctgtgagttgccatggggattctctcaccaccccccgccaacaccccgcaggggaagcttgttccaggagtcactgggcaggggctgctgctgctcttctgtgcccactcctcggatgtgccgctgcagccctggtctctggcatcggccgtcacctggtggagaggctgccggagctggccaagcagagggaggccgatggtgccacttggtgtctcctctggcatctgggcaggagacttctccccagaggccccgggctggtctgcccgtgtcacaggaggactcgcctctggtccctcagtggcctctgcaaaccctgagccagcctgggggaggctgctcagtggggaagaagcagtggccaggctctgcttggtcaccctgccctcctgtcagcctccggggctgcctcgtcgcacctgcccagggacccaacagccggtcctcacccctcccatcctcattgcagccaccctggggcattgtgaggccctgcacccagcactgccccttcaagcctcccacagggtcccgcccaggactcctgggctctgtgtccgcggggccatctagaaacactcccttgtccccccttcagcggcatagtacctgttgcccgccatctgagggaggtgcaggtgccaatccttcacgtgacgtgacgtggctcaccacagcctgtgtacatgtgagcagccgcgtgcagaggggaagctctgcctgggcctcagggactgtgacatggagcaggagccgcccccagccaagctgctttcagcacagcgtgggcccccagcaccttggtgcggggtgcggcccctcggaggagggctgtcaggtgaagcctcgtgtgagggggtgagtggcccccaggcggggaggagggggtgctgtggccttcctggcccctagcctggacacatgggggtgtggggagcaggagctggggcccccagcactggccccggggctgcgatgtgggggctgctctgtgaggcaggctcagagccttagcctccagctgcagggagctgggtcttggccccatcttgcccacatcctgccaccaggagcagagagctgcagctgcacccgggctgtgggggagggatgccaggtgtatctctgggtcccgggcccagcctgcacccagcgcctgaagtaagggccaccgggcagccccggaggtcaggagggaagtggagcccgtgctgggtggctgcttaccactgggcagtgaggaaggcacctgcgctgatgagtttggaaggggtatggggatcctggggccctgggttctgggaggttcatgcccaggcccccctgggccatcccaaaagccagtcatagtggggcccacaacctgccgtgccctgccgagctcccgcaagccacttgttgatgcttctcagtccaccccatgcctctcaaccgtttcctcctagactaggtctcttcatggcgtttctgggagaattcctcagtactagcttcagatccccagtcgtctcttccactgtacgtgtgcctgaagctcaccacatcccttacttcagtccttctatttttcagtccctggattttgtattatttcttgttcatatccacctgtccttgtttcatttccgccagtcggttcagaagttctcattcttgtctacggatgccattcctttctttgcctctttggagattctaaaggtctctgaaatcattattagattactgtattaccttccttcctactggaatgaattcacctccatgttttttattctgttgcttacctttcttagccttcatatacctcttgcgctttgaaattgatttgcgactcctcttagctgagccaatgttgtggagacagggagtggcctgcagtgcctgaaactgcagggcagcagccgcctcccaggaatgtcctgggtcctttcctcctttgaggtcccctgccatatgctcagatggggccaggcacagcaacgggggcacacctccctttggcccagcagttggggtgctgccaggcctggtggaggtacttggtaaacatttgttatggaaaagcagcaggagggttctaaggctgggattctggagcccaggaacaggccaggcatggctggagcgggtccgagtccgtgcactgtgtcctgtatgttgctcttagccgcactcaggagcagatgtgcaggtcactgcctagaagctggtgggcacctccgtgcagcaggctctggggggtatagccaccatctgggcatgtgtacagagggccttgctagtgcgacatatgaggaaccagaagatgtgtgggttttgattaaatggagttttaattaaagtggccaggttgggggaggtgaggaggaaggcaggaagcagcagcagttttgagtctgaccgcgtggaatcctataaggtggttctttcaagaggcattatgcacattccgcagcatgtgtcccctgtctgtatggggcagcatctgccctctgatctgtccccaacaaggggtaatcacagagaagtattacattattaatatttaatttcccctcctggttagcaacagatgactcaaggagtaattagatgcacagagccaacagagagggataggaaattgccagatcctggccccgccccctccccggggcctctgaccttcctgtcactctgggaggcttctgagggaggggagctggaggcccaggagccttcctgctgctgtgctctctgtgcgcacggccgcagccctacaccaccttccagtgctcttggtgaggctgagagaggtcgcttcgtgcctttgggcctcagtttcctcatctgtaaaatgggcttcctgggaccagcaagatcacagatgacagtcatttcccaagctcctaagcaggctgcacaagctgtgtctgagggtccagtgcagtgcctggcctctaggcaggtgccccctgggacgcgtaaggtttggcagctcagcagtgactggcatcgtggccagctgactctgtgttgctccccagttacggtccacgacacattagtagcttgaaactgggcacaaggggagaatttacaccacagaaatcaggcaaagcctgtaagtcagggtgcccccggccaggagctgatttgccagcctacggctgggtagctcccaacctttccccaatgaatgcactcctcttcccctgtctgccccaaaggtgcctctgactccactgatctgctttgctcagggccgagaaaggcacagctgagagtggattctggcttggcaggggcccaggttgcctgtgggtccgggcaagcctcacccgggatgtgctggcagcagctgggagagcctgcaggagtgcttaaggaggggctgagggagaggacgggcagcgaggtggcctgtgtggaccctgctggcaggagccgtgggtgtctttagccccgtgtgaggccggcctgggcagaggggtctgttgctgtcactgaggctggtgggcagcaggaaggtggcttcagtatagtcaagaaggttatcggtatctagtgctgtttagcatggggacccacagcacagaaggtggggagaccctgagaacgggggtacacaggcaggtacccagggctgccagggaagccttgccaaacagaggccctggtcaggcttctcccaaactgggcatcccagctggcatggcaccagtccagcccgtgaggcaggcgccgatgatttgaccccaccagcagggctctgggtgatgggactggggagtcctccttcactttggcagacgtgttatgttccaccttgtttgcccccagcaaggcccttgaatctggagcgtggtctggggctgcatcagccttctagcctgggatggtcagattggcagaaggctgtggcatccttcaatgcagatgccctagagagggccgtggtgggaggcaggatccctgggtagaggcggctcctcagtggcccactgggcctcactggacagtcgcctgttgctgctgctggtggtgctgggcctgggagtccaccttggagccacaggccaggcacctgggtgggaggcagcccggggccagcaccagctccacttgtacctgttgggcaggggctatcgtgagtcaggtgggccctggtgagtactgctcagggagagaggccaagagcatcagggataactgtgttccttgagtgtggccagggatggtgccaggagagctggtctggtgcatccctgccaacgacacactttgtgaatggctgcctggcaagtgctccatggaaagcaggggcttgggaggactcggccctctccagctgctgcaggccctccgttgctgcagggtttctggctctgctctctccttcctcctcctgcttctgtgtcaatgctccattcccaggctcctagtaggggcaaaagggcctgctgggtgcaggagaacctccagtcccaggtatggctgcagcccgtgccaatcctgttccagccacttgaggtgccgacagcattggagttggagggaaagttggggtctgtgtgtttgagctctgtcacatggacaatggggtagaggggagcctggccctttgaacagggctcaggaccaggagtgacttcctctccaggttgccagtcctgctccatccctcatgtcctggaagagagagagagacgaggtggctgcccgagtccacgtgaaaggcagcctctgacctcttgtccccaggcaggtggtggcggctggcaacacactcatagggccccatgagggttcaggattggagggggtagatttgggggcctcttagctctcaaagaggggcaatttaacgggcagaggtccatttggatccagaccattcacaggctcgaaggggacactgggagttggggctgggctcaggcctgctggggaaccaaaacttctgcttctgaggggtgtcagtaattccattttgactctgggggagccattttaaatctgtttatttccttctcatagaatcatgggtgagagctggcatggcccctagaggtcatttggggtccagctgcctcaccgtatcaatgaggaaactgaggcccagaaaagaaaagcatttttgcccagagtccctcagtgagtcctggttccgtacctgctttctgccagggaccaaactcccgttagtcattcctggtgtcagccaggcagaggagcaggtgggggagagggcgtgggaggagggaggtgaggcagctccctccgagtggaagctcacagtcagctgcagcgccgcccctgccctgactgcagctgactggcaggggcacctggaggcagcgggttcgggcgcagtatgagagggcttaccctctgcggcagtgggagacaggaccaggcagctccccacatccttccacatccgagctccaggggtctctggcttgtcctttcacagggcggctggtgtcccttaggtgggtgctggtagttcctgggagagttgacgggatggagcaggccaggggggctgagaagttggcctggcgagagaaggtgggtgggactgggagagcctgggcagggaggggcctttctgggagggagtgtcatggggctggccgagatccaggacccaggagactggccaagctgccacaggaggcctgagaggctgagcatgggggggccaacactgacagactttaacaagtttctggctcccccaggaaaaaaacagaccacatctgatccttggccctgagtccagagtgggaggcaccgtgacaacaatgcgcagagcagggaatgcagggagccatggatagtgctggggtgagctggagtcctggcaggggcccagctagggcagtactcattctgcagagcctgggagaaggggctgcctccttgggaggggtttgtgtgggagtctcagcgggaattctattggaccaggggaaccagccttgctcagtgacttctctgggtgtcctcctctaaagtgagggtcaaattcccacctctctcgcctcctggctatgaccacagcagaccaggcagggcatggggctaggcggggtcaggggccatcctcaggctgacacctggcctgtgggtagggtgggatctgaaactatagggtcttcagggggccaagtgtggggtaaggggtggcactttccgcagggctcgccctctgcagatggttcagcttctcatcggctgtccctttgcaggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggccatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtgagcagggccggggttacatctgtgcaaaggctgttggtgcccaggctttggtctgtgcccggagccagggtgagcctgggatcagggcctggtctgcagtgtcagcatggtgagctggcgacggggccccaggctcagcaggggctccccagggccagcacgtggccagcagtcatgccgaactgactgacccctatgggcgcagggcagcctggccctcccaggcggcctgggttcccctaggctgcctgaggccaactgtgctctgctttttggcagatgagtgtggccagggtctggcattgggcttagcagggagctgtggtcccagtgacccacgtgctgccagcgggtgtgtctgggccattcctcacacacaagcaaaacttcccggatgatgctggggtggagtggggagccaggggaaaccataggacctcagagttaggagccgcccgccacctgccttcccccagatcctctgggccagccttgcagtgtgcacattaggaaaatgacccagagaggggaagtgacttggttgaatgccacagtgagtcacttggacctatatgcaaattctgttgctcctcaagtcaccaaggactcatcgtcttagaggcagccagtgtgctcaggggctggctgttggaggggatttttatggtgaatcttttgtgaagtgacttcagccaagtaattgtgcaaatgaagattttcccagaggctgaattactcggcatggattccacctacccaggccatagatgaggctagaaagtgcatccctcccttggggacgtcagaggccttctgccccacctcctggcccctctgccacagagctgggttccacagcctgggtggttgtgggccctgaggccatgtatgaggcttgaggtggtgcctcttgagagtcagggagcagggtgcaccatctctgcggtgaattatctgaaactggtgggtgcctatctaaagaggaagccacagcaggttgagggtgccccagcaggaaggaggacccagctagatgagcaaatggaaatttagagcgtcaaagccaaggggcccttagaggtcatttcctctcatcttcgggatggaaaatgagcctcagagaagacagccagctgtttccgggccacacaacgagttggtagtggagctggggcgagtcctggaaagaaatgtggcctgatccccactgtgacttcagtcactggggagcggtcatgagcagcctgtctcgcagagcctgcaccaggtggctgtccctgtcacctgggctctaagtgggagcaggagctgcactgggctgctccagggaaggggaggaatctggacctcacactgccctgtcagatgctctctatcccaggagagtctagaaccctcggcaaaggagaaggggaccctggccagccctgagaggggtggaattagggattgtcggactccaagtgcagtctctggtgagcctccatccattgctctgcgacgggcagagcagagtttaggttcgtccagtggcagctcagaacacggaggcccaggaggggccctgtctgcaggtgcccaggtgggccagagaacaaagcactggaggggacttcagggaaccaagctgagtctgcacactgatgggatgctctatggggaagcagaggccaagctctcacttttttctctgattcaaagggtatgatcagggctgccgttctcaatttaaaggagctcgactttttttctcttttgtctctccctttccttctctgttttctgagagttgagagaatgactccctatgtagtaggacaggatgtgctgtgtggctatggaaagttagctgcctctctctgggcccatttcctcatccataaaataggacaagtctctctgcccctctgagctcacaaaggtgttctgaaggtccagtgagtggatggggtgacagggaccctgaggagggttggaggcgtggggagggtggggattcagatctttgggttcagagccatggacctgccccctatcctctacccatctcatcccaacttccttggagctggaccttagttccacccagaccttgagccatttgactctgctccatgaggctctgcaaggcttaggctggtctcttctgcagggggccctggagaggatgacgacgatgatgttcatcctcccttgagggcagagagctttgcagttgccaaaggatgtcagctcagcatctcctgtcatcctcttggcctgcattgtggccaggcggatgttctgaccctcctgttactcacaaactcatggggaggccagagcagggaaggacatacgagtgtctcctgatgtggatggactccagggcccttcaggctgttcctggcccgcaggtcccttcgctttcctgttcctcagggcccctgggcctctgggcatgtggaggtgtccatgtgggctcccgagagcaagcggggtatgaaaggaacttggtgacactcctggccggcgctggagtcacagcctgcctcaggatcctccctcctcctttctcagctgggaatccagcctcctctacgtgccgtttcctgctccactcagaaaggtccattcggctagccctgggtctagcctcaggcctgccccactctccattaactttttttttaaaaaaaagaactcagttttggaaaaatctgttattttccaagttcagggaacctgttgggctagcacagggcctagtcgaggaactctgtgagaaagacttcaggccagaggcagagatgtagctctctgtgttcccagaggatagggaattcagggtgagagacacaggcttctttttccagttcccaggggatttttgcctcactgtcccctccctggctctcacagcagcccttggtggatgttctcgctggtttgaggaacaggccaaggtgcaggtggcagctggtggtgaggcccgaagtcctaacacttctaagagggcaggattgggagagagggctccctggaggaggtgtcacccagtgggtcttgcaggacgggcaggcagggtctcactggcatgagtgtgggggcaggtgtgtcaggaggggggcaaagcctgggacaagaccctgaggaaggaatgagcatgtgagcactgggtagggaagggtggcctggctgcctagtgacagagagagatgaacagagtgggcaggaaaggtggaggccaagtcaggcctgttcgtaccaggggaaggaatggaggtttccctgtgggtccatggctcttcaattcttggatcaatgactcctttggacaacttaggaaggctccacctactcctcaggttgggacatgtgcacataaagccccagctggaatcatggggcatattcttggaccatagggtgagcccccagtgtgggtaatggagatccccagaaaggggcagcctgcaagccgggggacacagagctgcagagggcacctccacaaagggtgggcagcagctctgggacccacattctctgacatgcctgggcaccccagagtggtggtgtgtcacgctagacagccttggcatcccttccagctggatggtcaatgtttggggtctaagacggcaagatgtgagtgtgttggtcacagatgcagcccaggatatgctgctgggcctggctgaggctcagctgtgattccatttgggccctgatgctgtccccaccccgtgggcaccagggtccagggctctcagcctatggagatttcttttgaataaacttagtctatttgcaatttaagaaaaaaaaaagtcatgttttgcccactctaaaacattaaaaaggaacaaaagagtatagtatagtagaaagttgtcctccataccccctgtcccccaccctcagttccctgcctgcaaggccatgttaagaatccttccagagatattctttgcatatataagcaagtgctattaatgtatgttttgtttctgtccccacacgggactttctttgcagagtacggtggaagactccccttgtgggttcccttttctgtacaagtcaacaattggacagaccagggatttccatactgtgttcccagaagccttcgggttggctctggtgtccccaccaattcactgattcaataaacatttaataagccccttcccttccccagcagcttcacctctgtgactgcctgggaatgtgggcgacaaggtttgctgctgagaacagtttgaaaaccagcaaagcaggtggcccagggcccaggcagctctgcaacacccctgtggctgcttggctctgctctgttgcctcaaatgacaggaaactcactattgcctgaggcaggccatctctcctgtgaacagctcagctgaaaaactcttaacctaccctgagttacaatctgcctccctataatttccacccactgattctccattctgcccttagagggcagagtgctgacaggtccacgacttggtcccattttacaaatgaagaaactgaggctcagagagacaaagttttaaaacattcctgttaacagggccagaacccaggaagggatatgcttttctcaggaataatgtcaaaattaatatagcttcccagtcaatgaggactatataaattactatttgcaaagcactaagaacagtgtccggcacagagtcagtgctatgtaatgtagatgtgagaatgagagagcctgagattttatgtttgcgagtcccacaggaggcagggcaatgccaactccctgttgcttggaagcaatgggcaagtctatgaccctcctgttgaggccctgttacaggtaaccaagcccccacggaatggagctgaggagctcctgagaatgggcttgtccggttactgtttggattcagaactgacctaagagattcagaacagacagactcgccttggcctgagttgcctctgggctcttggaatgtccacagcaagtccattcctctccttgggcctcaatttacccacctgtaaaacaagaggattggaccacataagagatcggaagccaccagggtttctctttttctcttttatttgaattagttgacaaaacttaaatcttgggagattttacccagaaaatcatctccccagccccacctgagatctggtaatagcaggcgtacgttttgcatggcgctgaagaccaggtaaacgccccaccagctgcctcctgtgtgtgctacctataggcgcctgtttgctacccgtgaatgagatggtttctgtggatgttcccagctccgcagttaagtagagcacatccttccccttgcacctttttttttttttttttttttttttttttggagactgagtcttgctctgtctcccaggctggagtgcagtggcgcgatcttggctcactgcaagctctgcctcctgggttcacaccattctcctgcctgtctcccaagtagctgggattacaggcccccgccaccacggccggctagttttttttatttttagtagagacaaggtttctccatctcctgacctcgtgatccgcctgcctcggcctcccaaagtgctgggattacaggtgtgagccactgcgcccggcctccttgcaccttctgagtgtccctgtctcggagctggcaatgcagagatggatgtaggaaagccctgcccccgaggggcccagatgtggtggggatctgctgcacttcggtaggaaacttctttgagatctctatcctggacttgaaggatgggtagggtttctgccaggtagaggggagtgtagtctggtcttgccagaatcaaaactgttaaacagaagtcatccctcagtgatcatcaaggttgccttcctaaattagggagactttttttttttattgtccattctttcatgaaatctaggccacctttcctacagggctgaggtctgcttactggctggcagatccagccatttcccgagtatgagactgggagtcggtaggcttggatttctgtctggctctcactcaggaagactgagtgatttcgggcagattactgtccccctggacctcagtatttccttgcaaatgttaagatggccatgtaaatgttaacaagtaattctctcatttctctccagagggctgtgggtgggtttggaggggagaaatggcatctcctttggcctgggacctcctcccctcttttaccctccatgctgcctctcctcaagggcttctggagtccccaagtcaaatggcaaatggggaagagaagacagggtatggagtacaagaggcctagatcctctataggtctgatctggctggtgctgcccctagccagtaaagccaccctccagaccccttcaagcctgttgtagccttaaccaagatcaaccaacatggaggtgactgatcttggttaaggctgcgaccaacatggaggtaattgatcttggttaaggctacgacacgtttccctttagagaaaaatcatgttttccccctcaaaaaatcatgcgttaatttcctccaaccaaactaagtcccaggactactccgaaaactactcaatgaccatctgggcatttgtacatgggtttccatttcttggatgcctgctctcctgttacctcccagaagcctgtgaaaaaggcaaggcatattacttccacttaacggaagaggatgctggggcgaggtggcaggaaatgactggtccaagaccttacagtcaggaaatgtggaaacgggtgctgctctggggttctgaactcttggccctgcttaaccctggcttctcagatctctgatgctggtctcttctccccaggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgagaa

SEQ ID NO: 2 - DNA, 23649 bp, Homo sapiens
attcattacccttccctggatctgggggctttcggaatctcgacctccccttggcctatctcctgcagaaaaattagggtgagccccatcctcgatctgctccgccaagttgcgggaccgcggggcgtggcacgctcggggcaggcggtccgaggctccgcaatccctactccagcctcgcgcgggagggggcgcggccgtgactcacccccttccctctgcgttcctccctccctctctctctctctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcaggtaagtggcgcgagagcaccggcgggctcggcacctgggagccggaacccagtgcgcgcagcctcggagggtatgggcacggtctcaggcggcgcggggttgtgggtgctgcccccggtttgccaggaccacctgggagaggggcggtcaggctcgggttatcggcgtggtccggccgagggcggcattccgggaccctcacgccacccttctccagagcgtcgccgaccctctaattggtctccccagaagaggctgaggccgaaacagtagttcacacttctgaggggccctgcagggaggggagcagggaacttcattctgtaaacaggaggtgcttggaggtgggggccttggcgggaagggtctcggtttgctcgccaaccccctgccccccacccgcgccgatttcagctacccctagtttcgttgttttgccgacagggcggagctacagaaggttggagggggttgttgttctctggtgttggaaaaacaggagcggcacctcctcttccgtgagtgagcctgccctggggaggtctgagattaaccagagggccaagttcaggtgacatcaggcaggaggcccaacagaggctggcgccccctttcctcagtatagcagagcttaagcaacatctctttgtcaagacccaggtcaacacaactcatatttattgagcatctactatacacaaggccctgggccaggagctgtaagggcaaggatgtccagcctctggtcttttctctccccaacctgaggatcaagagggcacctctgctactttctaagcctcctgccttggggagtccttcctgggctcagcttgtgcctcccgcccccattttgcttattgtctgacactgtctctaggaccctagacagagccccggattgctcttctccagtcctcccccgactcccatgctatctgagcccacccctttggggtgtctctgggaccgtggacacctgaggactgaagttctgtggatctcctcccctcccctcagatctcagcttggggtttggcacagccagggccccttccccagtgtgggagtggaagaaaccacctgtgcttccctcacagttgctgggcctaaatttagatcctgggatttttagatgtgaacactcccagctggtggaggggggtggtctggggactggcgtgggagggagcagtggagtgactgtataactgtcccatccagactcctgcaatcttcacccagaaacccaggagtaccagagtctggccaccctccctggggaggcaggaggcaggcatggttgggtctctttaccctttatctgggtcctgcagcctctgggcatccggccctgtctcagtccttctatagcccctttgtcctggctgtgatgggggtgggggatgttggaggggaggcctctggttgaggaggggctggagattctggctctatcccacccctagtgctctctaccaaaggagggcctgtgacactgcccctccctatgctcccggttcctgggtacagcagggatttttatgattcccttcccctgccctgctccccaagctgcctagctcctccccagaggtgttgtttgtgctcccttcctgcccaggccctttgccccctgtttgtgtaatatggactttaccctcagggtagcagggaactgggctacctctaacactgtagccttccaagcacagacacaaagtctgcacaaacacttatgggcacgtgggatagatggggccacctgaaatacttcctgcaaggaaacccaactatagattcctgagccagcaggaccaatgtgtacgtgttcgtgtgtacattgtgtgtgtatgtgtgtgcccacactactacttccctgtgcagaaagcttggctcctcccttatctggggagaagtgttggcactataacttgggaaagggggtatcctgccaggaaggggattggggtggggctgttccagaaatgactaaccttcctagtctctttcatttcaacccaaggaccctggagttcccagctcctctggaactagctctctttgctgggactagccaaccttcatggggagtgataaggagccctccaaggtcaagaagtcagactaggggtgtatgttataggagggattggggcctcaccagtctccctccctccattcccactgttgcctcccactgagctaccaccgcctcagggaagggtggctggaacaggtggtatctaccccctactccccaccccacacatggtctttccctgaaccagaggaaagagactggggtagggcttcagagtccaggacttcccatagcccgttgtccaccacatttgcaaagaagagtgaactcccaaggctgacatgccatgtacctctagtctaggctctcccctagtgtgggtgaggattgccatggtgaaaggctttttcatgaacctcttctaacaatgaaattgtgtggaggctcaatatggggcatctgctactatctctctccaggttcctctgtatttgctgaaaaatactctagggctggaaagtgatgctgaggttgctagagtgtgttgggatgggggagagagtgagaaggaaaccctgagtttaggaaggcggggaggcaactagctccttatctttcagctttaaagacaaagctcccattgaccccccctcaccccagcactgccagagctcccccctctactgaggtcacttgtctgagcccaaggcttgagggtggaggggagtgctgctgaggacggggtgtctagggacagggtggggcagcccccctcctggatagaatcgcctcattgtgggctggactgtggccccaggcactgcccccaccctctgcccccatcccaccctcagtagacacaataggggctgtgtactagtcccaaagagatatttattccaggacctagagagaggcaggatgagggtagagaagtgagtgccctagttggagggggagaggagggtaatcaaagttgcggccttttcctaacttctcttttctagggagagaaacaaattccctgtcttccttctcagttaaccccttagtacccaaaagaagcacagaggggtcccaggttgaaaaaggaaatcttttcaccttcccattcatggaatggtaaggggattctgagaagagagaaagctctcaggccactacagcttctgcctatcgcttgtgggagggttggaggcaaatgccatctgatcctgtctaatgtaactggaagagggcaaccaagggggtgatctttggggatggcagatgggctgagaatttgtgtccagccctcagccactcttccctctgctttgaacagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcaggttagtgagcccaccctccttcctcaacctgctcctctttattctcccctagaaccctccttccttcttcagggctaccttctgctggagttcacccttcctaagactcaggagttcctaagattcaaaaccgtgtatttatggggacagtggctgtcatctgggacctatggtctcactgttgtagccagggatatatagggggcagggtcaggggcaggtggtgttctgtggatagtgcaaggtcagcagggactagtgcagagagaaacctgaggaccaagaggttacctggggagatgaggaaggggccctactggtatgaggcactttgaggagaaagctgcctgtcttcactcccagaagtgacacagcagtgtgacacagtctactccctactcccaaataggaattagcaagagttaaggccaggtgcagtggctcatgcctgtaatcccagcactttgggaggccaaggaaggcagatcacttgaggtcaggagttcaagaccagcctgggcaatgtggtgaaacgctgtctctacaaaaatacaaaaattagctgggtatggtggcatgcacctgtagtcccagctacttggagggctgaggtgggaggattgcttgagcccaggagtttgacgctgcagtgagcgagattgtgccactcgtaacagagcgagaccctgtctcaccaaaaaaaaaaaaaaaggccaagctcggatcacctgaggtcaggagttcgagaccagcctgaccaacatggaaaaaccacatctctactaaaaatacaaaattagccaggtgtagtggcacatgcctgtaatcccagctacttgggaggctgcggcaggagaattgcttgaacccgggaggtggaggttgtggtgagccaagatcgcactattgtactccagcctgggcaacaagagcgtaactccgtctcaaattttaaaaaaaagaaaaaaagaaaggaaagaaagaaggaagaattaaaacagttaaagagtctttaatgcctgaaggaggagaggagattgagattattttgccctgttgtctctctcatttacataatctgctctgtcacagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccggtcagttcccgatggttccttctggcctcacccctcagccagcccaagactggtacctccttgatgatgacccaagactgctcactctaagtgcctcttccaaggtgcctgtcaccttggccgctgtctaaaggtccattgctccctaagcaatagagggcccccagtagggggagctaggggcatctgctccagggaaaggaaccctgtgtccttgtggggctggagtcagagctggatctgttaaccgtttttctaatttcaaagtacagtgtaccggaggccaggcctgatggcttacacctgtaatcccagcattttgggaggccaaggagggcagatcacttgagatcaggagtttgagaccagcctggccaacatggcgaaaccctgtctctactaaaaatacaaaaaaataaaataaaataaaaaattagctggctatagtggtgcgcacctgtaatcccagctgttcatgaggctgaggcaggagactcgcttgaacctgggaggtggaggttgcagtgagctgagattgcaccactgcactctagcgtaagtgacagtgagactccgtctcaaaaaaaaaaaaaaaaaaaaaaaaaagcctgggcgcggtggctcacgcctgtaatcccagcactttgggaggccaaggcaggtggatcacaaggtcaggagatcgagaccatcctggctaacacggtgaaaccccgtctctactaaaaatacaaaaaattagccaggtgtggtggcgggcgcctgtagtccgagctactcgggaggctgaggcaggagaatggcgtgaacccgggaggcggagcttgcagtgagccaagattgcaccactgcactccagcctgggcgacagagcgagactccaaaaaaaaaaaaaaaaaaaaaaaccaaagtacagtatacctggatgtccctccttccctaggaattctacctttactctcctaaaccaaacccctatgagctggaggaatataggggttaaaaaccacctgtccatcttctgcttctccatgtcccagtcagttggaaaacatatgggcagggcttgggggagggaatgttgagtcagaaatctctccctctctcccttcccctcccccactagctaaaccggatctggacaggtgactgaggaggcaggagtttcttttggcctgactcctcatcttataaagggagtcttctctgcagcttagatttaattggacctatctgtctgcctcattctcccactcctgagtctcaggtgtccttttggatgggtggagaggtaaggaagaggcgttccgctgcggcccttaaccctgtcacttctttccctacctcagagattctgtcagggggtgtttatattgagaagaacgataagctttgtcacatggacacaattgactggagggacatcgtgagggaccgagatgctgagatagtggtgaaggacaatggcagaagctgtaagtggccgtgatcaagattgctccccagtcccaccaaaccagagtgactcccttctttccatcatccttacattcctgatctgaacccgcctccccagtgaacaaacacctcaggtccctgactcagcagcccaccagggcagaccattccagtctcctggaatctaaaccacagaggaggtgtttcaagaaaaggagcaggccgagcatggtggctcatgcctataatcctggcactttgggaagccaaggtgggaggatcgcttgagcccaggagtccaagaccagcctgagtaacatagcaaaaaatctacaaaaaattaaaaaaatcagacaggcgtagtggctcgcacctgtaatcccggctactcaggaggctgaggcagaggattgcttgagcccaggaggctgcagctgcagtgagctgtgattgtgccattgtactctagcctgggcaacagagtgagaccctgtctcaaaaaaaaaaaaaaaaaatccctgagtactaagcagggaagccagatctttagactccacatctgttactcgttccactagaatatactcccatttccttggagcccaccttcccctgaccattcacatgcatatattcctgcatatattcagtttgcccaggaggaactaagttcctgggttgggactaggactaaggttggcatttgccccagtccctccccttcagctgcccagtgggtggtgtggaggcgtggccgcgccccttgttgacaggtccacttgagcccagccctgctctccaagggcagggagggacacagccctggctttttgcttcccgggattgaggtgcctgtgtactgacatcataccccgttgattaaaacaagcctttcttagccctgatggccccttgtgttgccttccttcccaaccaggtcccccctgtcatgaggtttgcaaggggcgatgctggggtcctggatcagaagactgccagacatgtgggtttgaaattccctccaaaaacttcactcatacgctttcatatcccttcctccccaagcctgggtcaacactgtgggggaggcatgagcagtggcctcagaattcagtcctaggagccctaacagccatgctttctctccttccatagtgaccaagaccatctgtgctcctcagtgtaatggtcactgctttgggcccaaccccaaccagtgctgccatgatgagtgtgccgggggctgctcaggccctcaggacacagactgctttgtatgtaccctttccattgcctgggttctgaaattgggatgtggcctttgaggaggaggtaggggtacacacgtaacataaatctgatgagcctccttttttcccaggcctgccggcacttcaatgacagtggagcctgtgtacctcgctgtccacagcctcttgtctacaacaagctaactttccagctggaacccaatccccacaccaagtatcagtatggaggagtttgtgtagccagctgtccccgtaagtgtctgaggggaaggaacaatgatcaacaatagtagatccaagattttagacaaaattgtggaagggaaaaagaatccagttggtgataaatagggagattggtgaatggttatgatcatctaaccactccagtgagtgacccttacgtccagtcctcccatgacttcagctatcacccttacttctgctccttgtagcaacaaatagtgaagagacttttgaatctatagggcagcacttaagggatctagggtggcagatggggacaaatccagtgcagagctggagggagcctaggcccagagcaagggttccattggtagctggtgatgttcctccctcatctctaatggtgtcctcctcctcttccctagataactttgtggtggatcaaacatcctgtgtcagggcctgtcctcctgacaagatggaagtagataaaaatgggctcaagatgtgtgagccttgtgggggactatgtcccaaaggtgggtaggagatggtaagaagttgtaaagagacagcctttcctctgagcctgcgcagaccacccccactgaacctctcttacatttgcagcctgtgagggaacaggctctgggagccgcttccagactgtggactcgagcaacattgatggatttgtgaactgcaccaagatcctgggcaacctggactttctgatcaccggcctcaatgggttagagatcctgccttccctccttagaccccagcccacgcacccctcacagttcatttcattggccaaaactttcctatgtggagctgactaggaatcaaagtcataaaattctagcctgttacaaaggacctgaaagaatgcttaacacatcctccatccaggccttcggtcccctcaggaacatctttgagcaattcaatatcgccctgccaaggaacaagggacaggaacaacatatcctccttcttaaagttttcttttttattcttttttcttttttgagatagggtcttgctctgtcacctaggctggagtgcagtggcgtgatctcgactcactgtagcctcgacctcctgggctcaagtgatcccaagtagctgggactataggcacacaccatcatacttgactaatttttttgtatttttttgtagagacagggtcttgctatgttgcccaggctgatctcgaactcctgtgctcaagcaatcctcccatcttggcctcccaaagtgctagggatcacagcacccaacctccttcttaaagttttgtaaaagttcttccttagatttggataaaaatctgtctccaggctgggcccggtggctcatgcctataatcccagcactttgggaggccgaggtgggcggattacgaggtcagatcgagaccatcctggctaacatggtgaaatgccatctctactaaaaacacaaaaattagctgggtgtggtggtgcacatgcctgtaatcccagctactcaggaggctgaggcacgagaatcacttgaacccaggaggcggaaattgcagtgaaccgagattacaccaccgcactccagcctggcgacagagcgagactctttctcaaaaaaaaaaaagaaaagaaaagaaaattctgtctccccatgacttttagctgttttcactcattctgctccttggagcaaaaagaacaaagggactttctagtctataggacagcatttaaaatgtgtgtgtgtgtgtaaaaaaaacccactatgaccacctgtttttttttttcctttaattttttattttgacataattttagatctacactaaagttgcaagaatggtataaaattccccatatactttttttttttttttaagacaaagtctcactctgttccccaggctagagtgcagtggtgcaatcttggctcactgcaacctccgcctcctctgcctcccgggttcaagcaattctcctgcctcagtctcctgagtagctggaattataggtgtgtgccatcatgcccggctaatttttgtatttttagtagagacagggtttcaccatgtaggccaggctggtctcgaactcctgacctcaagtgatccacccgccccagcttcccaaagtgttgggattacaagtgtgagccaccgcgtctggccccccatacactcttttacccagatcctccaaatgttaacataccacatatggccgggcacagtggctcatgcctataatcccagcactttgggaggctgaggcaggtggatcactaggtgtggatcacgaggtcaagagattgagaccatcctggccaacatggtgaaacctcatctctactaaaaatacaaaaattagctgggcgtggtggtgtgcgcctgtagtcccagttactcaggaggctgaggcaggagaatagcttgaacctggcaggcagaggttgcagtgagccgagatcgcggcactgcactccagcctggtgaaagagcgagactctgtcccccgccaaaaaaaataccacatacgctttatcacttctctctctctctgtctctctctacacacacacacacacacacaaaacacatgctattgtttttctggaccacgtgagggtaaattttcacacatggttctttcttacccctgttatatttcagcgtatattccttaaaaataatattttcttacataaccacagcatagttgtttgaatcggaaaattaacattaacacaaaatattatctaagctacagaccttattcagatttcactaattgtcctcctaaggtttgggatcatacattacattcagttatcgtggcacttcaatctcctttataacagctcctcaggttttgtttatctttcatgatattcttgatgagtatagattaggtaatgggcagcatgttcttcagtttggattagtttgatgtgtcctcatgattagattcaagtttttgtagtttttttttgagacaaggtctggctctattgcccaggctggaatacagtggcatgatctcagctcactgcaacctctgcctcccgtgctcaagcgagcacctcagccccctgagtagctgggattacaggtgcatgccaccatgcttggctaattttatatatatatatatatatatatatatataaataatatatataaatataaatatatatatataaataatatatataaatatatataaacataaatattatatactatttatatatttatatatgtgtgtgtatatatatatatatttttttttttttttgagacggagtctcgctcttgttgcccaggctggagtgcagtggcgtgatctcagctcacgcaacctccacctctcaggttcaagccattctctatagagacagggttgcaccatgttgtccaggatggtctcgaactcatgagctcaagtgatcctcctgtctcagcctcccaaagtgctgggattataggcatgcgccgctgccaggctggagtttgataagaacaccacagaggctgtgagctcagggcatcctattgaggatgtacgtgatgttgatttgtcccagcactcacaatgatgtctctggtcacttagttaaggtgatatctgtcaggtttttctactgtaaagttactatttttccattcacaattaatgaatgtcttgggataattgcctgaatcaattattgttatgatagttgccaaatgataattttctaattccattattccttctgcatttgtttgttggcattctactgttaggaagagtctttccagctgagcacagtggcttatgcctgtaatctcagccctttgggagccagtgggaaaattgcttgggcccaggagttcaaggttacagtgagctatgatggcactactgctctccagccagtgcactcactctgcacaacagagtgagaccctgtctcttaaaaaaaaaaaaaaaaaaaggccaggtgcagtggctcatgcctgtaattccagcactttgggaggccgaggcgggcggatcacaaggtcaggagttcaagaccagcctggccagcatggtgaaaccctgtctctactaaaaatacaaaaaattagccaggcatggtggtgtgctcctgtattcccagctacttaggaagctgaggcaggagaatcacttgaacccaggaggtggaggttgcagtgagctgagattgctgccactgtactccagcctgggcgatagagcaagactctgtctcaaaaaaaaaaaaaaaaaaaaaaaaaaaaaaaggtcttcctttcctatttactcttatggatacttattttattctagtcaatggttataatcctttacaatcattatttattttagccagcccctccaagttggctcctgtgttctttgggctgtacccttaattctttgagtcttgtcttgtttgcacaagatgctctgggcttatattatatttcccccatcccagccatttctccaaggaatgtttccttttagtggagaatgatatttagaaaccaaatgctgaggctgggtgtgctcattgccattgagttatacctttaccttattgactggtttctactgttctattcagagacccctggcacaagatccctgccctggacccagagaagctcaatgtcttccggacagtacgggagatcacaggtgagtggcagagagtttgccctttctagaagaataggtgaaccactggcataaattgcggtataactacttgagaaaatcacgtcccaagttataggggaggagccaggagaacccaagaaagaagaaggctccctgcccatatgcctctctccaacccctcaggttacctgaacatccagtcctggccgccccacatgcacaacttcagtgttttttccaatttgacaaccattggaggcagaagcctctacaagtgagtaaagggtatggaggaaatggcatcttcaggcaatgaagcctgtgtcataggcattctttagtaaaatacaaggcactgtctcatacagcagtgcctcaaaaccaaagggtttcagagtttcacgaggaaaaggcaaaaggagggggattccctctcagtggatctgactagcactgagcaaatttcttgactaacatgaatcctttgaatagttaatgttcccttagtagtctctcctctcatcctgtctccttattctcagccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcggtgagggaaagggtctgctaggtggtgagaatagggagtcagggaggagagggctgaaaggactattctgccctagacgtgggagtagggttgagggatggaaccaaggagaagggggctgttaggctggaagcagtaacgaggaagaataatgaagagagggcttgctgggagtcctcagactcctctcctaacccaccccttcctttccagtggcagagggcaaagtgtgtgacccactgtgctcctctgggggatgctggggcccaggccctggtcagtgcttgtcctgtcgaaattatagccgaggaggtgtctgtgtgacccactgcaactttctgaatgggtacagtaaggggagccagtcaaggatgggtgggggtggggccctgcaatggaactgttcaggtggcatacaataaaagtctttagacagctttctgcatgtgccttggtgggattgaggtaggagacctgtggttgtgagatcggagcatgaaggtcaggacttggaagtgacccccccctccctttattccccactacagggagcctcgagaatttgcccatgaggccgaatgcttctcctgccacccggaatgccaacccatggagggcactgccacatgcaatggctcggtatactagtagcaccaggatctccaagggagacagagaaggggcaatacttggagcatctggggaatgatatggctaaggatagcacagagaggccagataatgctagggcctgcagatagaagatcctgaatgtctgggttggtctttgctgggaggtatggaattgaccttgggatctgattcttcctgaccttctctcttccactcagggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtcagtgatgggataataaggagagggggtcaggtggaagggtaggagcacagaactagagtgagggaagcagaaagaagagagaggctgtgattcaagaatcactcccagctggccgggcgcagtggctcacacctgtaatcccagcactgtgggaggccgaggtgggtggatcacctgaggtcgggagttcgagaccagcctgaccaatatggagaaaccctgtctctaccaaaaatttaaaattagcccggcgtggtggcgcatgcctgtaatcccagctacgcgggaggctgaggcaggagaatttcttgaacccaggaggcagaggttgcggtgagctgagattgcatcattgtactccagcctgggcaacaagagtgaaactctgtctcaaaaaaaaaaaaagaatcactcccagctgtgtagcgaaggattggagaaagggaaaatcagtaacagcacaaaattacaccacagttttgggaacctggaataacctcagttcaagggagtttcacagaagaggggcttggggagagctagtgagctggaggtggaggccatgtcttgggatcagctctgggctccaggatgggatgccacggtaagttctgaaacaagcttttatatgttaggctgttgaaattgagcctctgctgtccaagctctcatttaaggtggtgactttcttccctaggtgtaaaggaccagagcttcaagactgtttaggacaaacactggtgctgatcgggtatgatggggttggagattctggaaactggggatatttgggagttgggagagaggtggttacctggagagaagagggaggctgtcttcattctggccttttatgtatgcagtccactatcactggacacttgggactcaagaatgcaggcttctggacttcccttcctaaaattaactttcagtagtctaagactggtccagatttaggttggtcccttcagtgcttaaggatatatatgtgaatgttaatttcttgccccaggtcagcatcataccttcaacacaagtatagttgacatttgtaaggaagatgcaaacccaggataatgttgggtttctatatatcccatagcaaaacccatctgacaatggctttgacagtgatagcaggattggtagtgattttcatgatgctgggcggcacttttctctactggcgtgggcgccggattcagaataaaagggctatgaggcgatacttggaacggggtgaggtgagtacttagcttacttttgttttttcttttctttttttgcatgtcctggaagtctctttatagcttaattttgagtggtaccctgtgcacccaggggtcagtgatgggataaatgtcactcccctcctctttccccagagatttgatccctttcttcaaggaagtagtgtggtcccctagaagaacactggtcagagaaatgggaggcatgcattctagtcctgattttgccattaatttgccacatgactttgaagaagttacttatcttctctgtgcctcggtttatgcatctatacagaggaaataacatttgtccttccaggatggctgtaagggtaaagggggatgatgtatgtgaaagtgctttggaaagcacagagcactgtataaaaggtactcaaggtggtaatagtactaccaactctccctagctgtccccttccccactttgtgctcctccatcaaagggaaaacccaacccctttgattcctgatctcatgagcacaaataacttcctcagttctcagggtctgtacctcaatatgcctataatccattccaggactaacggtgcttcctcttcctgccctttcagctgtgctgcttttggcattcacctatgaggagcgggttggagtgggacatgggaatggcctttcctgagtaactccttcccatttgctcctcagagcatagagcctctggaccccagtgagaaggctaacaaagtcttggccagaatcttcaaagagacagagctaaggaagcttaaagtgcttggctcgggtgtctttggaactgtgcacaaagtgagtgacccataggaattctggagaggtggggaaggcatctagggcaaaggggtgaaagatttttgcataggattgacctagggagaatgaccttatgccaactcctgccccaaacttcccagggagtgtggatccctgagggtgaatcaatcaagattccagtctgcattaaagtcattgaggacaagagtggacggcagagttttcaagctgtgacagatgtaagtgaaggaaattctgtatgccgctaggagagaggacaatattagatacaatcatgtagaagcagggtcctgtgcttctcagcagctactatgttagccagaatgttgggggtgggggggcctgggctggctgtgcacatgctgagtgtatgtgaacctgttggtttcctagataataccttttgtgtctcttagcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaaggtgagagaagcctggaggaattctgtgataagaactgcttgtctgggggccagccaggaaaaagtgagaaggttgaagttctgagaggtgaggtccccaacccccgggctgcagactggtaccagtccatggcctgttaggaaccaggccacagagcatgtgagcggcaggcaagcgagtgaagcttcatctgtatttacagtcagtccccatcacttgcattaccgcccgagttccgcctcctgtcagatcaggggcagcattagattctcttaggagcttgacttctattgtgaactgtgcatgtgaaggatctaggttgtgcactccttatgagaatctaactaatgcctgatgatctgaggtggaaaaatttcatcccaaaaccaaccctccccttcccctggaaaaactgtcttccacaaaaccagtccctggtgccaaaaaaggttggggaccactgctgagaggtaccttcaagatttgggggaattccagatctcagtgactgattcccccaaccttaagaatactttcttcccctatacctacagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaaggtgaggagacacaaagggtaaggaggcgggggtggagtgaagcatggggatagggagcagccagtggtctcttccagaggcaagcagatgcttcatggtaagttcaaggagagaaggctgcagatgccagatattttagttcagagggcaacaaataaaataatgatcaagaacttgggactggccgggcgcggtggctcacgcctgtaatcccaacacttcgggaggccaaggcgggtggatcacaaggtcaggagatcaagaccatcctggctagcacggtgaaaccccgtctctactaaatatacaaaaaaaaaaaaaattagccaggcgtggcggcatgcatctgtactcccagctactcgggaggctgaggcaggagaatggcgtgaacccaggaggcggagcttgcagtgggccgagatcgcaccactgcactccagtctgggcgacagagcgagactccgtctcaaaaaaaaaaaaaaaagaatttgggacttggaaatcctaagaaaatttgtggaaataaacttgtgatacctctatctttaatccgcagactccaattaagtggatggcccttgagagtatccactttgggaaatacacacaccagagtgatgtctggagctatggtcagtgcatctggatgccctctctaccatcactggccccagtttcaaatttaccttttgagaccccctcttagaatctctaagcacttcagatttttgtgttagatcaggttctgccttcccttcacttcatgcccatgtctactattttgccagtgactagtccatgtcttcctgcaacaggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgtgagttacctgctgagcccaaccattttctctttttttctttttttttcttttttttttttttttgagacagagtctcacaattgtcacccaggctggagtgcaatggtgcaatcaatcttggctcactacaacctccgcctctcgggttcaagagattctcctgcttcagcctccggagtagctgggattacaggcgcccgccacacctggataactgttacacttttagtagagatggggtttcaccatgttggccaggctggtctcaaactcctgacctcaggtgatccgcctgcctcagcttcccaaagtgctgggattacaggtgtgagccatcatgctcggcctgactgcagccattttctgacttccctctgtactcctcttatggctctattccttttttttttatggagtctcgctctgttgcccatactggagtgcagtagcgtgaccttggctcaccgtgacctccacgttccaggtttaagttcttctgtctcagcctcccagatagctgggactttaggcgtgcaccaccacgcccagctaatttttttttgtctttttagtagagatggggtttcactatgttggccaggctggtctcaaagtcccgacctcaggtgatccacccgccttggcctcccaaagtgctgggattataggtgtgagccaccgcgcccggccatggaatgtattctcttttatgtctctacctcctacatcttatctccaggttggatgattgatgagaacattcgcccaacctttaaagaactagccaatgagttcaccaggatggcccgagacccaccacggtatctggtcataaaggtgagtagggagtaggaggtgctaaggaaatttagaaaaaggaggagttggctggaaccaggattccccctaacaatcacctatcgatatagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtggggtaagacaacttctaattacccaacactttgcaccctgagccctcacaaaccctacagatacccagattaactactcaaaggcccccatggtgaatgtagatttctcccttcatcttaaccttttccttattttttcatcctagagccagagccttttaagtccatcatctggatacatgcccatgaaccagggtaatcttggggagtcttgccaggtaagttctgttgctgagaggctgggttttaggatcagattgatacgagtagtatggaagacattagaaacctctgaggtttaatcagtgtcctgcaaaaaagaaggcagtgagggccgggcgagttggctcacacctgtaatcccagcactttgggaggccagagagagtggatcacctgaggttaggagtttgagaccagcctggccaacatggtgaaaccccgtctctacccaaaatacaaaaattagctgggtgtggtggtgcacacctgtaatcacagctactcaggaggctgagacaggagaatcgcttgaacccgggaggcagaggttgcagtgagctgagattgtaccactgcactccagcctgggtgacagagcaagaccctgtctcttaaaaaaaaaaaaaaaaggccaggtgcggtggctcacgcctgtaatcctagcactttgggaggccgaggtgggcggatcatgaggtcaggagttcgagaccagcctgaccaacatggcaaaaccctgtctgtactaaaaatacaaaaactagctgcacatgatggcaggtgcctgtaatcccagctactcgggaggctgaggcaggagaatcacttgaacagggaagcagaggctgcagtgagccaagataatgccactgcactccagcctgggcgacaagaacaagactccacctcaaaaaaaaaaaaaaaaaaaaaaaaaggcagtgaacaacccaatatccttctaaacaaatctctcttctttcctcatcatgtaaatttccttgcattattttctgtttattttcttccttaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtaggagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtgcctgactcttcctagggctttcctcaatttttcctcgaattctttccccgggctcctcttttttcttctctgatcatatgcctctctgtcctattaattttttcaaactttcccctaccctcatgaagttcttcacatacctagcctttcttctcaacccccaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctctttaaaaaaaaaaaaaaaaaaaaaaaaaaaactttagaactgggtgcagtggctcatgcctgtaatcccagccagcactttgggaggctgagatgggaagatcacttgagcccagaattagagataagcctatggaaacatagcaagacactgtctctacaggggaaaaaaaaaaaagaaactgagccttaaagagatgaaataaattaagcagtagatccaggatgcaaaatcctcccaattcctgtgcatgtgctcttattgtaaggtgccaagaaaaactgatttaagttacagcccttgtttaaggggcactgtttcttgtttttgcactgaatcaagtctaaccccaacagccacatcctcctatacctagacatctcatctcaggaagtggtggtgggggtagtcagaaggaaaaataactggacatctttgtgtaaaccataatccacatgtgccgtaaatgatcttcactccttatccgagggcaaattcacaaggatccccaagatccacttttagaagccattctcatccagcagtgagaagcttccaggtaggacagaaaaaagatccagcttcagctgcacacctctgtccccttggatggggaactaagggaaaacgtctgttgtatcactgaagttttttgttttgtttttatacgtgtctgaataaaaatgccaaagttttttttca

SEQ ID NO: 3 - DNA, 132899 bp, Homo sapiens
gctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcaggtaaccgcgggcacgccagccccgcagtccgctgggtgcctcgacgccacagctctgctgccttccagcctggggcagggctgcgcccctggggcaggtcacggctgctttgctgttggggcgggggggctctggagccggaagagtgagtcgcaggggaggtctggcagaggaagcgccccagtgccctcgggggcccggaggagggcgcggtggatgtgggaggacagggcccttctggtgcagaggggacgcggtgcaccgtagagtaggcgcacggaggcttttttggccgggtgcgctgctccatcgtcgcctctcttatataatgttgctggagtatggggttccccatctgccctcttgcgtcccgtccctcccgttctcgcttttccttcggcccttggtcaccttggccacagggccaagaggagcctccacccacagcgccaaggattccccacgattcccggatttcactgcgcctacggtgcgcatcaggaaggaagtcaggttaaataaaccatctcctccgaaagtgaccaagaccaagagtcagctatgatgccctcacccaccgcctagagcaacaaacctttcttctcattggtttatcagctccaaatgaccccgctcccccaaggctgacagcctcacggtgaagggcaggtcgcctgcttggggacctgctgcctctcactgcggaagcaggaccagaaacagacagccttcattgatgttcagggtagtgccagccccaccacaccacaccccttggcagcaaccggttgcttttactttctctttttgcctgggcgaggggtgtgcagagaactttgtttcttggttggactgcatcatgggcactcaatgggccaccctccaccggccacttctgttatcgtgcctgtatgaggaaggaaaagattgtccaggcagtttgaaaaacattaaattgttggtggctcttattttctttgcagctaagctaagttaccatctggtttagacttccttcggagagcgatgggaagagatttctcagagtgtgaatggcatcatcctatctacagcaaggacctggaaatgaaccctgctctgagtcacacttctctattctcctttgaccctgtgtgctaggaactaccaaaagaatcctttaaaataagatcctttattgccttgataatttattctgcctgccccacaatccaaggtggaaaagttcactgcagcaactaactacagtgaaaatgcactaacttttcaatcactaacctcttggttcccatcgacatctgcttcagtcctgtttttatctccttcacaaatttcaggatttccctaattcttgcaatctctgcaatcactgccctttatcactgacccaaagcaaaaagcaccaggtttaactctgttccccctgtgctaggtccccacaggttttgttatcctgtatccttccttactcctagcagctactctgatcgattttctctcaccctcagagcagacttgtggccttgtttggggaagcactggaattttgaacccccagccatttgggtcaattgtttggcaagagtgtccgcttcatgatgctggtgatggcatgcacctcgtcacatgtgcacggctaggcttgtgcaggtggcctctattacccaaacactgaaggagcccctctgtgtccttggagagatgccaggtgcttagtttacatttttgcctgcttggagagctaacagcttgaagtaaaccaatccatcagggactcctgaggttttcaccagccaacaccacccaatcgtgcgtgaagactttctgactccctggacattgccatggactcaactgtcacttcaggacctgtttttgaactaacaaacctagacttctgattctctcttgctgcacctacctgtacattccgaacacatggtagagactctacaaaatgcttaatatgtgatctatggacggttcccctgaaattataaatgctgccatcttcatccttcttgttttcccaagctatttccctatccatttgtctgtggttataaatgtcaatatccagcttctctttggaatgtgtgaagctctttggtctagggaccaaaggcaggaattatttagtgatcagacaataagaaaacactgaaagagatgatttgcctttgatggatgtaaaaatactaaaaatttattttcaatttatggtaatgctacttagccattttctctcaaacaccactggagaatttatataacatgaagcatatacaaaatgcatctagggggtaatgaggcttctcttcatcaacttctgccttttagatttgccccaatattgtacttggaggtaaatattaaaactccattgaggactggtataaagttgtaaagtgaacaaaacccagtagaaagctattgataaagaatctattttataaaataagttttatacaataaaatctactctgtaattaccttttcaaagtatatttctaaaatagcttatatgcccttctgtaccaaattttctaaataagggattatgttcacactttctcagtcctccttccagctcttcaacctactatcccaataagggtcgtaagactgaggcagtttcaacagctcctgctaaggttaaagaaagatacggggaagcatcatgaaaggataggactctccctatctaatgtatgtttatacataccttatatatggaggctaataagtttcctttaagtatatcaataattaagatctgtactaagtgaccactataagtgtcacattgaaattgcatacttggttcaaacaagggattagtctgagaaaaacatctatattcagagatgtagcagtttgttaggaagtttggcagctccactttaacatagctactccacacctctcctgtagtgttttagtgtttcaatctcggactcctaactcctgctttttccactgtataaagaaatgtagctaatccattggattctacaaaaattttgaaaaatccagaactgcaaactgcaaaggaaggcaaagctgctgcttccccagttcacctgtttgggatccagcacacaaagcagaatgcccgggaaagacagcagcaagactacagggcaggagaggggctgtttccaacaagggtgatgggcacgtctcctgcaggagcagacttcttttttcttctgtaatttttgatactttggaatgcaagatttattttggagaggcaagagagaatactttggaaaagatgtagatcagagatctgagtagctattgaattgtgggagaaggccatgagagaaagtgtgagtagtaatcttatagcacattttccttttttgttgactgtcttcccagcctgtgtccatcaagtagaaaatggcagaggaatgtcaaagaagaaagtgtgagggatgtggctgggcacggtatctcatgcctataatcccagcattttgggaggccgaagtgggtggatcacctgaggtcaggagttcgagaccagcttggccaacatggtgaaaccccatctctactaaaaatacaaaaattacccgggtgtggtggcaggcacctgtaatctcagctacttgggaggctggggcatgagaatcacttgaacctgggaggcggaggttgcagttagctgagattgtgccactgcactccagcctgggcaacagagcaagactccatctcaaaaaaaaaagtgtgaaggatgaaagctgctatggcaaacatccttagctgcaatcctgtggaatacttttaaaattcagatttaaaataactttaagctttaaaggattgttgttgctgttgttgtttctcttgtcgttgcttctgttatttaaaacaaaacaaaaaaatccttccaaagttcaagctgcagtgagacttaattttatagttattatttacatggtaaaattcccctcaagtcaccagtccctggtatgggaatttttaactctgaaagcctttgaattattactaggaaaagcatctggtgttagtgaaaccagtgactgtgaagctggtatcaaaatgaaagtgccttttgggaaccaaaattttacaggtctttctgctgaactctggttcactgacagtgattgcttaagcttgtctaaaatatttcagctttactcttatcaacatgatttgtgctgtaattgtttaaaattttcctttgtaaaataactaaccaaattatctgattatagtttgttgtaacagatgtgaatcttattccacaaactcaggtgtgcaagaaacaatgcattactttattttcagaaatccaaattaaatttgatgctgagctcccattccaccaggttgccagaacttcaataattgtccttactggggtctttgccagctcatgcaaagtgccaggggaacattcagggaggattcttctttagtcattggatcccgctggttacctctgggttttccattgtccaaacccacaggatcttgtatctggtggctcaagactcatcagccatcactttggtagttcctggagtttggggttcagccttcttaggtgatccacactgtcaatccccccaggctttccccaggccctgtcgccttcctgagggtgccacaagccagtgtatggctggatagttgcagacgactgtgatgaaactgaggacaatgaaactgccacagtggagctggccacaggttctaccctcagaacccagacctctgtttcttcttgtttctgtaccccactgttctgctgctccctcagaaatttccccatttcctctgagatacctcaatgaatttaggtctccaaaaaatatctagggggaagtggtctttaagaaaattgtccttaagttttcctttttagtggccccactaacttgccctaaggcagaggagcacagaggcctcactatgtacttggatctgaagaaaggaacatatatatagtgcacatgctgtgttaagcatcgacttttcatgtaataatttaccctgccgtagtagctaacatgtaagcaaggcagaattatggtcccaactagacttttcattgagatgaaaactaaagagcttcttttgtcttattaaatgagaagggaaaaatctttcatgaaatagcaacaacaaatatacatgctactctacacgctttacatggattagctcctttcatgctcacaaccatcatatgaaaactggagcacagaggttaaatgatttgccctgatcctatggctaacaagtagcaggagcaaaatatggacccaggcggactggctccagagcccgtgttctgaccctacacactgcactgcctctctgctcaccactgtcccaccttttgtagtcccctgcagcttaaaaagagtgggaacagactgaggatgggaacagtccagtagtgctcagactctcctcagcaggcagggagcaaggcgcttcaaccacataatctacaatctgtctgtccatttgactcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatggtgagtattagagagggactttgaccgatttgctgttgtgcttgtcacatgtggcattaaacatgcacaatttagtaaaaatagagtcgtacattagtaagggcagtgagtaagctcttcacttccaggcactgtgcagttactttgagcgacattcttacaagtccatggtatttgcctctactttgcaggtaaggctaagagagataaagtgccttgtctgaggtcacacagccatgttgtgataaacctgggatttcatcagatagatatgtacttcttatgatggtcttctaaaccctagaggaaaggaaaccctagaggaaaggaatcattagatttgtacaggctaaaagtcaaatgatctaataatgttgatcttattctaagttttaaaagaagaagaaaggtcaggcgtagtggtgcatggttgcggtcccagcttctcgagagactgaggcagcaggatcacttgagcacacaggagttcaaggctgtagtgtgtaatgatcacgcctgtgaatagccactgcacttcagcctgggcaacatagtgagacacccatccttaaaaaagaaaagaaggagaaggaggaaaaatatattttttcttgcctacggattttgaataaaatgggaaaattttgagtggattttcttatttattttcatttttgcatggcaaccaaattttgatgtttatatttatgattcagcattttaagagtggagtttttcagttgcttccgaaaataagtatattaatattgccttgcggggagcggaccatggacttagccctgagtctagggactggattgcaactaatttctaagttaaagaatgagtagatttatttttttaaccattaaatgtaattagctatctcccaagcaaatatttttcattatgttgctctaaattacaccaaatgtcgatatgcatataattatgtcctctaagtcctattatttccccttgcctttctttacaaatttccctagctttacagtggctttcttcttctcttaaagatcatttaagctaaatttggcctcaaagtcactatagcagcttgctcccatactttccattatccatctgcacaagtttttctttctagctttctatttcctagtgaggatgcaagaattattctgagaatgtcaagttctgttgtggagaaatattagagaattagagatagggtttccttttcatcattccctggcctttgaatagttgacagtctgtttctgcgagccagtttcctcctaaaagtaaagcagttgctttttggatatgacttaatggcaaatttaaattctgtgccacaaaagcccttctccaacttgccaactaagaggaaacacagagccaaacaaaatgccttttaattggatttaacttgtttcattgtatttgtccagggatcagaaaggataattttcttggcagggttcttttagtctcctgatctaattcttttgaggggcatagttgtaatcttaaactccctcagtccccagtgtcttcatttcaatataactggttttcctttttatcctatgtattttatgtatgcatttctaatgttcttctgagacagggactgtggatttcacccagctgccaaagagatcagtagcacaaaaaaggttaaggatctacccaggggaccacccagagagagctaagcaatgccaccagcataacccaaaggcatgaagtgtttcttgaccttttcaaatataatatttgaaacactaaagctttttttaaagcatatatagttgtgactagtcaaggcatacctcaagttttaatttgcacagaaaccagggccaaacttgccacctcttctctgtttctgtctgggtgactggtaccatctaagttctacatgtcagaaatcagcaagtcacctgagaggtttcaggctcgcctcttccaccactccaatataatcaaatatgaagtcctggcaattctacccttttcaatttatgtatatcccttcttgttcttaggttagggactgctgtcttaagttagggactttctctaggactccgctctcagactctcgatactgattgttgtccccaccttcttatctagcagtatataaacaaaacatacaagatacccaagtcccaacaaagtgaaatccaaggttacctggtttgttacagcaaagctagggcttaaaaccagtattccattccccaaacatagcttctttctttcccccttggctttagcagtataaaccaagttttcacttgtgatacaagaacattaatttatcactgtgccttgggttgcctctcaccccaactcctatcctgtgtgagtcgtgttcatctcagagaaaactgaagttgtataaattttatgagtgaactgcttttgactagcacccaggtgtacattaatatcattaagataccttgatctcactagcacttttcaaattttgaatgtttggtgaatcacgcagaggaaatggactttttgtggcagggtggctgcagaactatcagaattctgggcaactcttagaagcctgccaacaacctctttatccattgaaactattttgtctcatgttactgatgacattaatttgctagttttctgcataatcacctcatctcacaaatttgtaactattgcataataaagctgttgttttaaggatgctatcatcataaatttgcacattcagagaagattcttcccaggaaagtctgtcttgctaaggaagcccatggtgtgtaagaggccagcatcagcaaagaatgtgtgggaacaaaatgcttagtgaatagttagcgtaatttagctgcttctggtgtggtggttgtatgcttatcattcttcaaagcatatattgtgacttagagagcttattaattgaagcccagctttgagctatgaaatttaacttgaaacttgagaaggcacccgctgatgtcacaagttgtccttataggtcaagagtctaatcagagagagcccattctcattcctgtcacttgcagctgagtgcctgaatgtatcacttgactactctgcaaaaatggggatttcccagacaagtataatacctcccctatgatctcacaggtttatgataaagaacaaatgacagaaatgtataccaaggcactttgtattccaaaaatcaaaggttttagaaaagaaaactgatggctctacaaggaacagtctttgtgttcagggactgtcctcttaggtttgtaatatgggaaaagaaactggtcatgagctattggggggttttgatgcggttaaactgaaacataggtaataagcagaatccttataaaatataaggtcaacacactctttaacagaagtacgcttttgaaaactgtttctatgacacagcaaaacaaaaccagtgatctttaaaagactatttgccaagaaaagcatccagattattattaccttttgctataggtctgcttattacattctaagctgttaaatggcctcacactttagttagacggacactggaggaaaagaaagtagaatcaaatactgtcttaagcacacttttaagcaaatctgtgagacatttggaggaaccctaattgcctggtaaacggtgataagatctgattactatgatttacctaatggccattatttgatctgttaatgactgaggtttttagcaaattgtggaccgaggttttggcaaattgtgacagggatacagggatagctgttctataaaaacacctttccaagagaattagtattgatataagtatcaaacattctttccagcatttccaggcatatttgaggttggaatcacttttcagttcctccccatgtaccagggaaaatgattgaagtaaaagctatgtctactacctcactggccccccgccggtcacatgactgccccattgaagctgctgcttctttcacaccccaaattaccatgccttgtaccttcccaagaatctgctcagaaattcagcagctcttccttttacttcctcaaaaaccacagtctcaattctacctccagtctctgaacaatgggactatttgtccatctttctaatgccgcaggtggttccaaagtccacacccaccctcagtggttccaaggaatttttctggctccaacactttctaaagaaaagaaaatagaggtaaatgtaacctcagccagggcaccctttctggtgaagtgctctgcggcccacagcagagttagtagaccctcacctgatcaagccaggctctttcagcgcctcatcacaccacagtaagtgaagcttcacatggttgatcactgaacgctatccccagtttgcaaaagcagaaacagaggctactagaggttggatagctagcccacaggcaaacagtgggttagcagggagccagcattcatatccagacctgacagcacccatgctctgaattcctacactcggatattgtattctaaacaacgtttcttttaaaaacagttttagaaattagccacctgacgctgactacccagtttttaactctcttttccccaacttcctctccaacccagagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctggtatgtatgggctggtaaattttatgtggaaaggtagtacatttatatgaggcaatagggagaaggaagagttcaaagtgactcaaaagtgactgcaaaaatattatcccggataagaagtgtatgtttggaggagaagagagaggtaatgtgtagccatgaatttgccttcagaagcaggcccggaagtgaaccaaggcggatggtgtcatggaggaggaggagggagtgttccatagcaccccagggagaggaagtgtggaaaaggcatgcacaattaggaaattgctgctgacctttagtagtttcagaagactagagggggtagaagctggattgtagtggaatgaagcatgaacagaaggaagtaagcctcgtaagtttcacggagcagaagaagagacagttggcaaaggacaaaattgcaacaaatttatgtagttacaatcttatttggctttattgcaattctagaatcaggcaacacctcatttcataaaatagactactgtaagtgttccagttcgttgaacagaggggattggctttgtagacagaaaaagggctgaagaaagcaaaaacagaaaccgaagagtggattggtcatttcaacgtaactttccttgtaagagcaatagagaaataattgattggtcaacatcaggtgacttcaggttaagcattgaaacagagggaacttcattatcagtccaattaaagattgaaactggcctgttggggaaattaggcagttgtctctctctcctgatttctcaaaagaccagatgacaatctgtttcagtttggtgatgtggaactttggcatgggtgactccattttgatttttgagtcctagatcaggagcttagtccaaaacagtggcttttttttatttaaaaaagcaaagggtagtttaagaaagagatcagttgaaaaacacttttagaatggtgaaatcttaagtatgtttatggcctgaagcaaagagcgggaaagagaagagatagatcttcctggctcaaaattggtgacactgttccttccaccattcctgtgtgtttgtcagagtgctttttctcgttactttttaccagaagcaaactgttcaggatttgctaaagaatttgctgttctttagaaagacagagagagaccaaagtagcaatcacatcattatctggcacataactgagacacagtttctcaccaattaggtgagagttacaggggatcacggtacctgacatgtgataggtactcacaaaatattacttaatggacaataggttgaaagaatctatagcaaagagaaaggaaagagctccagacctaagtaataatagttaatacttaacagggctctgccaggtgtcagatactgtttcaggctctcaatatacattaactcattcagtcctcacagcaaccctgaaaggtaccatactttatccccattttacagatgatcacagtgaggcacaagggagatatgtaacttgcctaagatcacacagctaataaatatcagaactagaattcaaacccaggaagtctggctatgaagtccttgtcccaaacagctacactaggctgactcattgagtagctagccaggtggtattagtaatgctgatccctccttcgggaatgtgagcttcagaatgcagaagctcttggagagcttggagagattatactgggttaagacttaagatttcagggtgcaacagaatcacatggagagtttgttagaacacagatatctagggcccagagattctgattcagtagatttttggtgggccccccaaatttggcaagtttccaggtagtgctgataatgctggtctgggaaccacacttggaggattacatatctaattagaggcccaggcttctcaacacctgtaacctacctactaaaatagaaaaagccagtattttcttcagctataattgataataagcagagtttggtcagccaggtatcaacttcatttaactctccttatcatttggatcagaaatttagatgtgaaagtttgcttagaggtaatccaatgtaaacccctgtttctcaggtgagaggcagaaggcccagatcagtgaaatgacctgtcagggtcagaccacatttttgtggacactagtgaaggattctttatcctccttccccactgtacatatttacccccactgtaccttgctgccttgacaggaatgtatcttggtgcctttagcctcctgtgggtgttgtgtgtgtgctggggctttgggggtgtgacacatacagtggtgttaatgcatgcatatgcttcctagagttactttttatggaagaagcaagagaaagtttctcaaacctgagggctgctaaatcatggaggtcatgttgtatagcaaacacactgccatcccactcctggaagcttctggatttacaagtgtagggcctcagtggtaataatgaacctttagacaatgtgctttcaaatccaccctattttgtttttatcaaatgtcagaatctctgttgctatttatgctatagaaaaatggctgaagcagcaggatgtgccatcagaggatcaacaagaccagtgccctcattatagctctgtcacagtcacctctaggtctttgttcctgtctgttaaataaggacattagacaagatgatctctaaaggcccttccagcttataggatcatgagtataacatctgatatgtaactggctataggaggccttttggaaagtcccccagttggagcctgggatgcacttgacacagcctgcattggacttcccctcttgtggggagtacacaggaggctctgaatatattttgaaccagttgttttgaaatttttatttctcattcaggaaacagcttgcagtttctttgtctgaaattatgcatactctacaaacacatatgtatatatgtttctatgcacatatatacacacaaatacatatataatgcatatgtaatgtgaattacatatcatatattctttattaaagtattaaggagaaatttggacatagtttcccaaataaggtagtcacttgggctcaatatcttggccatttaagcagcatgtctgtgcacacacataaacatacagtggtttttatgcaggctgtgggcaaaccctctgtcatctgccactatgttcaaatgagcttgttttccattagctcagtgttcacaacatgtgcacactgagacccatatctcaggcagagggcagtcagggacatgggcgaaaacacagcattgtaattgatagggataaaaggagaatggaaaataagaaagagtggaagcttcaaccagcctgagtcatttggtgtgtcatgattccaattttattgtgatcaaaatatggtctaaatgagtgatggcagtctccctttgggcatatcctaagagtatgcaaattgacttgcagtatttctaagcattctaagtaatagaaaacattatgtccttactttatgatcactaacgtgtctttatcaacagaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaaggtagattttatttgcatgtgatagagcaaattggctaaaattgtaaaggtacttcttcttctgttttcatatccagatgtgtttctttgtatgtaacttttctgacctctcttgggatttaaacttctacactgaaacccataagcaaaaaagtactgaatgtaatcatatttcaccattgagaaatgtatcttgtgatggaaactaaagagagattgatgttcagaaaacaaggttgggtagcaagattaaactgctaccctaatcctaaatgaaaggattttcaaaaagcgaataattaaactctttgaacattgaaaaatagagaattaaaggaagggaaggaagatggttaagttacactagatggcctcagtaaacatccttacattgagtgaaagggtacagtcctcaggggcaaggagtgttttactaaatcttaaagtggatttaataacatggacacagaatgggtaggactttgttttgttttgtttgggggatggtagtggtaattttttaatttttaattatgaaaacttaatagataagaataaataaaaactttaaaagaccatttatcctatcataagaatttaagtatcaccttgttaatttcaataacaaaccctattggaactttgattggaattgtattgaatcatagattcattaaagaggaattggccaggtgcggtggctcacacctgcaatgccagcactttaaaaggtaaaggcaggaggattacttgaagccaggggtttgaaaccagcctgggcaaagtgagaccacgtctctacaaaaaaaaaaatttttttttaattggctgttggcatgtgcctgtagtcccagctgctctggagactgaggtagaaggattgcttgagcctgggagattgaagctgcagagagctatgatggcatcactgcactccagcctgagtgatagaggaagaccttgtcttaaaaaataaataaataaaaggtattgcagtttcaatattgtcttctcaaccatgaaaatgatatgcttttctatttatttaggacttcttttatgtactcagtaaaattctataactctttccatagtcttgtatatctttcaaaagaaactatataaacaaattttaatattatatttaaaaatcaaggaacctaagttactgagtccctgatgagttattctttgaatgaaagacaaataattgtaatatatgataatgatgatgtgccagacagactactaaatgctttttatacattatctcctttcatcccatctaactaccttatgaggtggacgttattgttatcctcattttgcagatgaggaatgcgaggctcagagaggaaacataacttgtccaaagtcacccacaagtatttagcagagcctaaatttgaagagtcagtttgacttgaaaacaaattgtatcacacatataaatggattcaccttttataagactgtaagttctttgcaggcagaaatgggtctcatgggttgtttttcacttttgcacaaagctgtaagctttattgctatatattaagcaaacatgtattgtctaagtaattcagatgcattctgtcacactattttataataactggaaatatttgataaatgcttactgtaagcaagccctactttctccagataaatccattaatcattactacaacctcatcaaacaaatgttttatcactagataaggaaattgatccttagaaataatatacccaacagcatacagctaagaagtatcagattgggatttgaatatcaacatatagaattgcagaactctatttatgtgaaagagggtctcaatatgttgcccaggctagtgtgcagtggatattcacaggtgtgatcagagcacactatagcctcaactcttgggctcaagcgatcttcccacctcagtcttccaagtagctaggactacaggagcacaggatcatgcccagcttttttgttatactacgtacccctcttagatatctttatctctttttatcattaaaaggccacaggtcttttgtcgctctttttgtttacagctttattcagacctcctttcttacttgtagctttacccttttcctgtattgtttggcacttgaatattcagatctttagaatgaaaatctgccaaataagccaaatgagctagtgtttggcattggagttctattccagacctcactgaagcctcagaaaaaatattgttgcgaatgaaaagtgccgataaattcaagtttcctagaatattgacatttggaaaccgatgacttcagtgaaggagaaaagtgccaaagtgtgacaatcaaatgttgcacgattctttatgcatcagttttctttaataactcatgaaagtaatgtaatatggtaaaggaccttattgtaccctactcctggccggacatgccccgtatttaatacatatcattaattttagaagtatatctgtttctaatgtttcaagttcctcttccagtgtgaaagcttcttaggcatatcaatacgcctaattatgactattggtttcccaagacccaagaaaactgtgttttaacctctaaaactctgctttctatctttctttcttttttcttttttttttttttttttgttgttgttgagacagagtcctgctctgccacctaggatggagtgcagtggcacaatatcggctcactgcaacctctgtctcctgggttcaagcaattcttctgcctcagcctcctgagtagctgggattacaggcacacgccaccacacctggctaatttttgtatttttagtagagacagggtttcaccgtgttggccaggctggtctcaaactcttgacttcaggtgatccacccgccttctatctttcttaattgctgatagcatctggtcatcaaataacaaatttgaatgatctatctccactgtaccacgtgtgtgtgtgtgtgtgtgtgtgtgtgtgtgtgtgtgtgactctcactctcattctgtatctctagtctaaacaggaccctttgggccctagagccataagccacatatatatatgttatattatatataatatatatatatattccattgtctatgaaacagctcctatacatatttctgacccagtcccagaaaaacttgatcatatggggatccatgtctgtctccttctactagattgaaattctcatgagggcaaggactttgtcatttcagtttttacatccctagaacctggcaaataatatgtgtgcctaatgaatttaaattgtcagtctagaatacagtcagatcttctgaatctagaagtacaatggaaactgcttttgataagtcttctatattaataaaagaggattaaaaatagatagtgagacagctactctaagaagcttctgtccttaccttagatgaaagggaatttgacaagctaataggagagcagaactgaattaacttatcagcctttgggtttctcaatagtctgaagatttttgtctattagcattgcctacctttgatgcataaacagccctctacagggattgctgccttacaatcaaggtctgcagatttgtttgttattagtagaataagtctaatttagataataacttaggcaactttgtcactttttaaaaattttttaattcttacagaaaaagaaggcattgctaagattttctggattggtttaaatcagctatactctgctagaggctgggaatggtcagaccacaaaccattaaactttctcaactgggatccaggtaactgctctttccctaccccctctgcacagaacaaatcttcaaaaaagcaaaagcttctcactcaccaatagcttagaaaagtttcacatcttggcagctcttactatggttacctctcagaagaattttttcttcctaaaccattcttaattgtggtactgttattgccaagctgaaccacaccatggacaactgagcatttgaacctctagacctttagaacaaccctacatttttatgtaagagcaaaatgagctccaccacatggcccaggagccattctatgtccctaaaggacttggcatgtctataactcacccatgctgtgtttcatctgcagctgaactctaatatggaattatccgctcgttttcaaactcttggggtctctccccactatagcacccaagtactgacaatataatggttgtattttataatacaaataaatacctcaaagaaagtcttttagggaataaaacaagcaaaatgccacttagccaaaaagcattcttcccaaaggaaggattagacaactttgaaaaataaaatcttaggcttatgacaaatgtagaacctaaagttaacactaatttcagtataaagctgcctgcacacatagtaggaaaactgagttaagagcaataaaattcaaattagccactttagttaatttagtttgctaaatttccttaccagcaaatgaagtaatacttttattatttcagtaaatagaatatttaaagataatttaatctttaactcaaggccttaatggcatgacaatgataaattaatatttttattttatggagtagcagattaagagctactaagcatagaatatggcctggaagtcatttgaggaaaaagtttggtttttgtttttaaaattaactacaacatatcatgatgttttccctttagattctatattttagaagaaagacatatttaagcacataattattcattgaggcttatacgtttcaatttagttaagttttaactataatatgagttcccataaaagcataaaattaggaatacaaattattctttctgacaccatcctggccctaactttctcattctaatgctttgaaaaatgttcccttttaagacaggcccagtgcacctactataggtggctccagctgtgcaagaatggatgctgagtctggtctgtggcagagcttttcctgtgaagctcaactgccctatgtctgcaggaaaccattaaataatacagtggagttaacaggtatctttctcacatactcatacaaatagacaaataggtcttaaaatcatagttttgtgaaaacaagtaaatcttttccaacatccgtttccacctttccttctcctgatactgacagtacagaaaagtacttgatttttaaccctgtggttagatattatcaaccatatatgaataaagctttatttgaggtaatgaagaatattaaatataaatatgtatgcgcccagaagaaggcagagatattcgagataggaaatatacttctgttcgtgtgtggctcttttttctccagagcagtggttctccaggggtggtccccagaccaacagcatcagcatcacctcttcctgttagaaatgcaagctctcaggacccaccccagatttgctacatcagaaactacaggatggggtccagcaatctgtattttaagaaactttccaggtggttctgatgcgtattcaagtctgagaaccactgcagttcatgcctccgtaatgaggcaaaacctatagacacaggagtaagcccaggcttctctaccttgtgccccacagcacccagccctcttctatccttctctgtcaggcaagtctttgcattgaaaaatcaagtaaaaaaggagaggtgcagagggacaaaatgtgtacaataagggggtttttccagggtgtttggggatgaaagtgacacaagaacagctgaagtttttgaggagtggaagggtgtgaggagtttttgaaagaatggagaagaggagtgtattgactgtcaagcacagggcctgatgtatacctggtatttaattacatcctcaccaaatgagagaaactaatactcaaagctggagggatgtattcatccgttttcatgctactgataaagacatacccaagactgggaagaaaaagaggtttaatggaccttacaatctcacgtggctggggaggtctcacaatcatggccgaaggcaaggaggagcaagtcacatcttacatgaatggtggcaggcaaagaaagagagcttgtgaaggaaaactccgccttataaaaccgccagatctcatgagacttattcgctatcacgagaacagcagggagagacctgcccccatgattcaattacctttcaccaggtccctcccataacacatgggaatttaaggtgagatttgggtgaggacacagccaaaccatatcaaggggaaaggatgatttttaaatgtcctgctttaaggaactgtgagtgaagggaataaagcattcaaatgtcttgtcatctaaaaaggagtatagagcaatttttaaggaaaaactagatataaaataaagaatctgaggggatattttaagataataggggaaatgaacatttgtcttccaagttgattcaaaccaaatttagtccatacaacaaaaggcataatagaaaagccagcacaaatgaaaataaactagagcaattgatgatagattaagtaaataccttgcagtagcaattattaaataaatcatgatgtttccacatgattgaataatatgcatttactaaaataactgtgccagcaggaaaatacaaagaacaaaaccaaatgatatgcctacttatcattttaatcttgtaaaaatatgtattcattgagacaaagactagaatatgaaaatgattgcattaagttccattatgggtgatatttttcctctgttcctttatcataattataaaatataacaataatacatgctatttcagaatattaaagttaattgagttatctcgcaagtgtaagaggctagctgaatctgaatcactttatcctttagtaaaaaaaacaaactgtccacatttttttttctttttttttttaattatactttaagttttagggtacatgtgcacattgtgcaggttagttacatatgtatacgtgtgccatgctggtgcgctgcacccactaactcgtcatctagcattaggtatatctcccaatgctatccctcccccctccccctccccccaccccacaacagtccccagagatgctgtgttttcttacaacaaatattccaaatggttctaaatcagtgaagtctgagtaaccaactcactttctggttttgttaacggggatagaagtattctgtggggtttcatacttcattctttttttctaatctggaaagattagaccttcgattgtgagctttctcatggtcaaaacagaatcactaattccatgaggaccatctgtctagcagaggggaggaaagaagtccaggggtaacctttgccctctcatctcttggatgcgaagtgtataaatgtcttattctgtcccttaaatctctgcctgtcctttgttcaacggtgagcgttaatctacatccccttgctaagctggccatacaagaaaaggaggcttgccctcttataatcttctcaaggacagagactggagggaaacctaacaaattccatatccaggaaaaaatttgtcagaaaatgacttaaggcacatctttctactgtctacttggactaagggcaatctcccttgactgtgtccaagcccttaatagtctgtgctcagccatatagcacattgaagcatgttaaagtcacatcattttctgaatcccagcgggaattcctatgatgctatatatacctcatttatgtggtaggcaccacatgaattcatgtcaccgtagcatctgacatcacgtccccagttttccaggactctcattattcaagaaaaaagaatttgcaatgttattgattcacaatagatgtatctttactggaatataaatagctgcttttcccccagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgagggtaagtttttaaaaataccctatttgagaggcttaagccattttaaagtatccctggttttagactctttgtgggaatgaaaagcttacagtttgatcccacagatcagccctgtcagataggattgtctctggtgatggaactgttctacaattggtctagtatggtggtcactagcaacatgcagcttctgagcagttggcatgtagccagggcaactgaggaactgaattattacttttatttcatcttaattaatttaagtggccgcatgtgcctagtggcaaccaatttgacagtactgccattgattgatttccctcttctcatgagctaaattctatttaagttgctcaaaaaacttaagtgataattacttcacttttgtaattatttgaaagctaaagactggtaaaggaaaatatactagacggacagtattatgatctcttcctagaatagaactcttagctagaatagctaagagtaggtacctactcagtgccagcctggtgctccttgtttcacttgtgaaggcagcagagtcataccagggcagcagtggacagtatttctattcaaattgggatatgtatgattgtatttatagaatttcattcaccccacaaagcaaagtttatctacaccagatatcaggaacacccagcctgcagatgttctacctgtgtactttacttgcataagttacttgaaaagccttcattacccaacctgcctgtcgtatcaacatattaataaccgaattaagaatactacaaaggctcttaaaactccatatcagaatataaaaatttgtataacaatgtacatattacagtatttaattgagcaaaaccaaacaaataatacatttttcttttagatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagaggtacgaaacctcctgtggtttctttatattcttcctgttttacctaatgataatattaagacttctttggttgggaagtttgcgtataagctggaaaataaaaggtaagagcactctggatcagggtacagagccacggaccattacctgttaagaattgggccgcacagcaggaggtgagcggcgggtaagcaagcattactgcctgaactccgcctcctgtcagattggcagcagcattagattctcctaggagggtgaaccctattatgaactgcacatgcaagggatctaggttgcacttccttgtggaacagtttcatcccaaaactatcctcttccccaccctctgtggaaaaaattgtcttccacaaaactggtccctggtgtcaaaggttggcaacaaataatctaaagtctagactgtctttctggtagctactttaaaaaggtaaataaaagcaattactaaataagcaacccatatcctatctgagagcatcttttctggtctcaaacagatacagagaatccctttagaactcacattcttgtgctgactgattctagcaacctgctttctctcaggaccagggcctgcacccacctttctgccatcagtgtgatattcggcagatagccacaatttaacctgaaaaatcccatcttccaaattcatgttcagattgttttatatcgatactactttgagaagtaaaaaaatggttttatttaaaaactaggcctaacatttttcagaaaccaccttactcctatagaatgcttaaacattttttgaacatcttttacttaataatccaaaataggctgtgtcttgagcagaaaagatatatgtacctctacgttttgtttgtatcactttcctgtggacccctaattggttatgaaagtgactgtgtcactcagacatctaaagagacttaagtggaagcaataaatattatgtgtatttaaaagaagtttagaaaggtgtcacatttgatgctctatttaaaaggacatccaacatgtctttagaagaacatcagaaatggaaaagtgttcccatgggcaagagtgaattgatggcatacctagacagcattccaatgttcaaaactgacccttatcacaatcgacttattagaatttaattcaaacaaagcaaagtgacgtagtcaattaagcaaattaatgttaagtagcatatatgaaagagagaattttgaagtccagattgaagtagagttgaaagaaacttttgacctagaattcatggagaatagctattttagccaccatcatcattttacacgtgaggaaaccgagaaagggaggttgatgatgtacctaaaagtttcaaactttggctatgccattctagtctagaagactagaatgctggaactgtgggctgagttcttctctcttcaacttttatactaagtgtgctttgatggttttattgctactcttataagaaaatgaaatttatccacactgtgacctggaggtgatgctgaggtaactggctgtgagccatcactttgcaggcctgttgagtagcattttctaggagtgtgttctcacatttgataattcacttatattcatttctctctctctgtctctgtcatagtttttgtgagttcagttctgaatatgcggtaaataatttcctttccaagcaaatgtttttgtctcctttcaaagctaggtcagtggaaagtccaatcatgtgaggagaaactaaaatatgtatgcaagagaaagggagaaaaactgaatgacgcaagttctgataagatgtgtcctccagatgaggtaggtaaaatccctatgtaaattttctcaagcagtattacaacttcttggttagaaatggtagctgagacttaaataactcagacttataaaatagaggaaactactagcttctgttcatttaagttagaacaagccagaaggcagtgagtcatagcatattggccttcttacagaagcagaaacttgaaaatttctataaatatttgtagaattactatcctcaaggctgatgtctttacttcccccactaatatcaatattcaaaaataattcatccagtgaatattatactcttatgatgagccagccacccatatgagaagtaacccatactttttgtctgacacaggcccacagtcttgtggaggttatctgtgaaattgcatcccaccctcatcacatgtatgatttcaatagccatgtcctcaatttccacaagttctaagacgttatcaatgtagcagaaacatgcttgccagacgggacaccatcaagtctggaaaagagtttgacaatatttttcctctgacttagggctggaagagacatggagaaacctgttacaagatttatgaggatgaggtcccttttggaacaaactgcaatctgactatcactagcaggtgtgaccatcagtaaacttgtactcataaactttcaactctgaattcttttgccaaacagtcttcctaagtaaaaggtgcatcttcaaatagagtcaatcattgtgaaacacttgccaatttgattctccttttgtagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccaggtgagtgtcttaatctttgaagtagtagtatactgtgactagtgaaaggcagcactcctcccaaagatgttcctcacttacttttgaaatgtgagggacatgatgatcttcaggattggagtctatctatggaaccataaatagaagcagtggctatgtcttccctattatgtccttgggaataatccaatgaaagaaattcaaaaacttagttctcccaaaccaccatctaatggctcagagctagaagcaccagtgtgagtttttaaaatcttttccatgtaaatctcaaatagaatctagaagctcccgtgtgaggctctttacattttcatctctctgcttcttaacctattttcaaaactgaatgtgttttcttccattattctcaatgggtaagaattatggaggctatcttgtattatttattttgtttttgtttttgtttttgttttgagatggggtctcactctgttgcccaggctggaatgcagtggtgtgatctcggctcactgcaacctctgcctcccaggttcaagtgattcttctgcctcagcctcccaagtagctgggattacaggtgcatgccaacatgcccagctactttttgtatttctgtagagatggggttttaacatgttggccaggctggtctcgatctcctgaccccaagtaatccatctgcctcagcctcccaaagtgctgggattacaggtgtgagccactgtgcctggcttcttatttattttgaaagttatttcctctttctccaaccagcctaaagcattgaccataatttgccatagaatcagaacacttaagccggaaaggacctcagaaatacttttagagttaagaaaacagagactttaaaaggtgatttacttgacaaagatcatctggttattgaattaatgaaatccagagttcctgatttttaagccagtggctttgaataagacagcagtataaagcattctacttttcaccctgtgaattatttatattttattgtgttggtctaatgtgatcatgaagactattttttataacacagagattggaaaatatgagcttacaattgaacatgttatttgaaatagaaaatgcccacaaaagttaggacacatggtcatcaccatcaacatgagtgatgttgctagtaacaaagtcatccttttatgtctgaaaaagatagagtatacagatgttgatcctggttaaatctcagattaagaacactctaatggataaagcacatagatttctttttttctttttcttttttctttttttttttttttttttttttttgagatggagtttcgctcctcttgcccaggctggagtgcaatggctcgatctcggctcactgtaacctctgcctcccgtgtacaaacaattctcctgcctcagcctcccaagtagctgggattacaggcacctgccaccatgcccagctaattttttttgtatttttagtagagacggagtttcaccattttggccaggctggtctcgaactcctgacctcaggtgatctacccacctcagcctccgaaagtgctgggattacaggcgtgagccaccgtgcctggccagatttgttttatagacactaagagtaaaggtgacgttcttgataactaagtcttggtggttggagaggtgcttgggaagtagctaccatgactacttcctccattctatgaccagaaaggctatgtgaagctctctttaccattattgcacccatcctcagccaacttggtctatcatgggcacaccgtggatagaaggactgaacagggaaaaatagcacacccattcagggtagcaaggcaattatttttcccagtttcttattcctcttgctgtttgtgtatatgagactatgtggcttctctgtttggtgggatagaagttgtcctattacttttcagtatatgtaactcttcttgtcttttacctgcttcaggcagtgtgatgtaatggaaaatggaacatgatgttttgtcagacaaatctggtttcaaccccaactctaccattcactaactctgactgtgggcaagttacttagtcttcatttacaaaatggaactgataattcaaactaccttttaatactgttatgaatacataaaattatgactgtcataaaattaacggtaaacaaatgtatgttaccacatacctccttctacctttattgtaccagcttttcctttggatcagaatctgggagagttgtgttttgaggttaactaagtttcttaaaaactgctcaaagtttttaagctaatttgaaccactatcctaagcagcagtagtatttagggtacagctctagaaacagaccacctgggcacaaatcctggggcaaccacttactaattctatgaccttgaacaagtcacttcattctcactgtacctcaaattatgacaatagaatccccccataggtttgttatgaggattaatctttttcaaaaagtactttacaaataataaacacctgtcattattattctgaacaacatatttctttcctctctttgttccattttttttttattctctctccccaacttggctgaagtaaagagtagaaacactagaaaatgtttgaactttaacgttttaatttttaattgagctttccacttcaatcccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtaaagtgacattctcattctatccttcaatgaagttatttttccactacccttgttcatgtccttgtacaaattatgctcttctccatagtactatgtaacctaactaaagtgctctggagcacagagtccttggcagggcatcgctgaacctctggtgtgaggtgcctcagccccacaccctgcacgtgtcctacctgaaagggcaggcccaaagccagaagtggctccaccccaaggtctttttttcccagtaagttggtgtactatatgccatactgccactatgcctatgatcctcatattcctctaattcttgttgtcaaattaacagctccagcactcctaataatgtaaaaaaagtgtatatatatttacacttttacaaacatatatatatttgtgtgtatatatacaaatatatatatttatatatacaatatatatatttataaacatatttacaatatatatattataaatatatttataaatatatttacaatatatatatttataaatatatttataaaatatatatgtttatatatttacaaaatatatatgtatatatatttacaaaatatatatatatttacatatatttacaaaatatatatatttacataaatttacaaaatatatatatttacatatatttacaaaatatatatatttacatatatttacaaaatatatatatttacatatatttacaaaatatatatatttacatatatttacaaaatatatatatttacatatatttacaaaatatatatatatttacaaaatatatatatttacatatatttactatatatatatttacaaaatatatatatttatatatatttacaaaatatgtacatatttatatagatttacaaaatatgtacatatttatatagatttacaaaatatgtacatatttatatagatttacaaaatatgtacatatttatatagatttacaaaatatgtatatatttatatagatttacaaaatatgtatatatttatatagatttacaaaatatgtatatatttatatagatttacaaaatatgtatatatttatatagatttacaaaatatgtatatatttatatagatttacaaaacatatatatatttatatatttacaaaacatatatttacaatatatttatatatatttacaatatatatatttacaatatatatatttacaatatatttatatatatttactatatatatttacaatatatttatatatatttacaatatatatacgtttatatatatttacaaaatatatatacgtttatatatttacaaaatatatatacgtttatatatttacaaaatatatacgtttatatatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttactatatgtatatatttatgtatatttttacaaaatgtatatatttatgtatatttttacaaaatgtatatatttatgtgtatttttattatatgtatatatatttatatatatatttggtctgcatcagtcagctagttccataaacaaaccactagatgccatcccaaaattcggtggctatgacaacaaacatttagcctcacattctcacagatcttcaggccagctagagtttgactgatctagtttgggcttgaatggtgacctctgctcccaacttcaggtcagctgtgctgggctccagcccttccttctagagctcaggctaaaagggcaacagctcacaggggtttgttgttctcatggtatatcactggagcccaagaaggcaagccaaccatataagcacatttcaggcctctgctcagtttaccttcactaatatcccatcaacacagtaagtcatatggccaagccccatgccaaggtacaaagacgtatactccgcccaccagggggctgtggcaagaccatctaattatattacaaggaactgaagaattgggacaaatataattcatcctgtcattgtgtcatcatctcttcttcctcctctgcctcctcctcctcctctttttcttctttcttctttcttctttcttcttctttctttttctcctttcttcttcttttgaaacagcccaagttccaggtttacttttgccactttctgtcaatattcacacaccagtgcagactgctctttggttgttcctcgtcagaaaatagtgctatttttgtgtgggtcactgtgtcttatattcgaaatttctattgttagcacatttctttgccaaaggctactcccaaagcatttatatgtatcctttacagccttgcctcctggttcattttatctttcaaggtcctaggaatacaggagaacgtggatcttgttggaatagttccccagcctggctgaggaaggccatccatctgaccacaaggactggcatctgtgctggcctttagttgaattgacactttcagcaggacctgtctgtgtctcagtatatgtgcatttacctatgccttcactacacctttaagaattcatttcaggggcccacacatgtgacagtaattgactttagcactatgaaatactttatgataataccataaaacaaattaatattatattttgctaaggtattccatgcagaaagaattgtaagaaagaggaactgggaagaagctgaacgattctgccaagcccttggagcacacctttctagcttcagccatgtggatgaaataaaggaatttcttcactttttaacggaccagttcaggtaatactttaagaatgagaatttctatgctgaatttgatgtcctctagatattcaaaattgacatgttcttaccctcactctctgttggaaaaaaaatggacatgttttattatctaaaaggtcatttggtgcttagcagtcatggaacattaagcactcttaatgtgcagacactatgaggaatctaaaaatgaatgagatgtattccctaccctttgtttaataaagtccaacagcaatgtatggcagaaaatctagaatataggcaaggaagggccttgggaattcagaggagggagggagtgtttctgggagtataatcaggaaaaatgtcataaagaaggctgattcttggaaggtaggtattatttcaaaaggcaagataggagaaggagaaggagccagaaaaaaaacagaacataagcaaaggaactaagaccagaatatacagatatggtcaaggagaaatgagtcatacaaattagctagaaaatggaatttggatatgaaattggaatgtccttgtttgcaagggaaggagtttgatcttaagtaattaaacacaaccaaacaaaaaacaaaaacaaggtgcgtgtgtgtgtatttatatctacacacactcacatatacctgcatatatacatatatacacagagaggaaggggttggccaggctggtctcgaacttctgacctcaggtgatctgcccacctcagcctcccaaagtactgggattacaggcattagccaccacacccagcccattatcagttttgattaagtgtgagtctgcaaatttgttcaataataataaagtccaattctgcacttttgaaagagacttaaaacaaagcttgccaattagtacttatccagctctaagactataatgttcttttcctgggaggaaggggccacaaaatactacaaaattgtgaaattctaataaaaatccttaaaaatttaaaaattttttaaattttttaattttaaaaattaaagcaactagcaacattttcattgtgcaacagataaaagttagtgctgagtagctggtggcctcctgaaatggggcctgactctccaatttgccaggtctctaatttattacttcttgaccccacttcacttgcttatgttatgtgcttgtcttatatttactcaaatagcaattgagttaataatcacaagtcatgtgatcatcttaataggtactgaaaatgcattgggtaaaatccactattcattcctggtttaatacataaatatacacttatatttagtaaatataactaatatgtaaattcttatttgaatagaagaatagctcaaattaatagccatatcacacttaatgatgaagcattgttaagtgcatttccctgaaagtcagaaaaaggtaagtatccctatatcatcactattgttaatcttggtttgaaattcaactcctgcacattaagataaaaacaatactataatgtgtaaatgtttatatatattaagcagaggaaaagacagattatcaaagagtaaaaaatatactatttacatttaaaactagactgcaaaaagggtaatggctattatatctctaggaagtaagattttgagtgatttttaaagtcttttctatgggctgggtgtggtggcttatgcctgtaatcccagcactttgggggcctgaggtgagaggattgcttgaaaccaggagttcgagaccagcctgggtagcatagggagaccctatctctatttaaaaaaaaaaaaaaaagaattagctgggcatggtggcacacacctgtagtcctggttactcaggaggctgagtcaggaggatcacttgagcccaggagttcaaggatacagtgagacaagatagtgccactgcactccagcttgggcaacagagtgagatgctgtctgtaaaaaataaatgaatagaatgttttctttgaaaatttctatattttccagatttgctttttgttttgttttttgagacagtcttgttttgtcactcaggctgaggtacagtggcatgattacagctcactgcagcctcaacctcccagactcaggtaatccccccacttcagcctcccaagtagctgggactacaatcacatgccaccacacccagctaatgtttgtatttttttgtagaaacgggtttttccatgttgcccaggctaatctcagattcctggctcaagcgattcaccttccttggcctcccaaggtgctgggatcacagatgtgagccacagtgcctggcccagatttgctctaatatagcttctgctgtgtttttctcattagagaatgtagtttcactacagtgtactgggaatctaatgcaaaatatgatacctgtgttccataaatatttatttattaagcatctatcgtagaatctcaggtattctagacatcattgtccagtgttagaaattaatatacaaaatttcactgcagactgacccaaggcaatttgtatatactaaatactaactcttgggttctttgtgaggtgagtgttagctattccctcaaccttgagaatagattataacaaatgcaaaattcagaccaaaattttccacacatacagacatttgctatgcaaacattcattgaagcagacacaaaacattttatacaacgtgttttgtaagcttgacaacattccagcaatctgtcctttttggtgttttaactatcaccttgcacagatttacttgaagcagatgtggcagtgttctgtggcagcattctgttcccattgtagtgagtatcaggccatcacaatcacctgacccaatgactggatgtggggttgtttcgaatcaagccctactaagatacaggctgcggcctcgcaagattctaatacactcttgagaagtgtgagagtttctctaaatattttagctaatccctgcatctcaaataacttatatttcaccagtgagagcccaatcctaccatcatgctgatgaacaagcttccgatttcactgacattaacccagttctcacattcattctgctcatgaccaaagcctccagtgtgactttggtgatcatggaagtcctcatggtggccacctctggaccatggcctttctttttcttttttttttttattattatactttaagttctagggtacatgtgcacaacatgctggtttgttacgtatgtatacatgtgccatgttggtttgctgcacccattagctcgtcatttacattaggtatttctcctaatgctatccctcccccatcactctgccccacaacaggtcccggtgtgtgatgttccccgccctgtgtccaagtgttctcattgttcaattcccacctgtgagtgagaacatgcggtgtttggttttctgtccttgcgatagtttgctcagaatgatggtttccagcttcatccgtgtccctacaaaggacatgaactcatccttttttatggctgcatagtattccatggtgtatatgtgtggggcatggcctttcaaatacaccaccaatacttcctgacatgtaagtttcaagcagggcaacttaatggcccttagatttcaagcttgacacacacaatatcatattatccagataaagtatttttaagtaaaatgctgacataagctctagattccaagcaagaggttagtaactctaactggaacgaggagccatggataagtactaatgaatgaggttgtagatatttgtgagaaacaataagtagaaaacattggaatatcatatgtgatagaaatgaccattaagagcatccatatacagaacgaattacactaggaaacaaaacatgaaaggaaatttttatgatttgtttctttgttttgaatcacacttgttgagcactcccttctttaaaaaattaatacaagttcattatataaaatttggaaaatataaaaatgagtaatgaagcaaacaatcacctcaaatcctagctcctgattataaacatagtaaacccttagtgtaaaccctttctgtttacttacatctctacacatttagcttttacaaaacctattttccatagaatgtactatgtttaatttttttctaatcataaaagtaatgcacattgaatttagaaaacagaacagcacagagaaaaaacaaatctccttaatcccttcacttataggaactgtattttatttgtactctgatcctagcagttaacacaatgccatggtaagcagactgctttgtttgcttaataacttctccataataaagaaattgtttgcctgtgctgtgcttagagaacatattctaaaaccaaaattgtaaccatggcttaaaggaaagaaggaagcaaacccatttatattagaaaatgattctaaagcatactccttgaatgccttggctttttattgcaggaattgacctttctcagcaagatatccattgcccaaattgtgtattgcatgccaaggagttaagtcagattactgctgtacctctcacaatctaagttccacatctctatttgtatttcagtgaaaaggattcatggtgcaccaaatcattaaggctctgagatctttgcaactcttaatggcagcccaacagggacagccactgtagggcaaaaatagccataggattagagaagaaagccttgtttgcaatgccattgctgctgtgtacactaccccctgtgatgtggcaagaatggatttagacataaatctaaggctttgtagaataagcaccctcatcaaatagtatttattggggcttatggctgagatactgttttccttagcaaccaaatgcagcaggaaatttgattgagaataggaattttaacacaattacacatattaaccttttacgctatctcttcttaacccaatagttttaaaaccatatacttagtgcttggagtaccaggaacttataaagagagagagggaatctcagtttgacttgattccccagttatgatcaggtgcaattttttccttcacattttctaaaatcaacattggaagtgtgcaatgatcaatgtgatatccaatttcttcttccctttatctgcctacagctaaactaggccaaaccaggaatgagttacaattgaggaaatattttccacttctgatcccgcacaaaaaaaatacatacatgtcgctattattttctgtatttatgacatgctagtgagttctttaaaatgaagctgaaatctgtaaatttctgtgttcaaatgaaacttttttcaatctgtaaatttctgtgttcaaatgaaacatttctgaaatacagtttcagaaagtagtggagattagaaattttggacaatcgagcaaactcttttctgtaggaagctgtcctctgaggtgcagcaaaggagccagaaatgggcttgaaagcagagatgtttctaagtggaaggaaggggagctattagctgagagaagactgggtaagggcttgaggagcctagaaagttgaggatgaacctctaaaaaggctaccagtgggagcctctacaatgcaggtgacaaatgatctttgatcgtcttcctggttgtattgtggattgtgtaaagaagataaaatagctaatgcttactttagggaaacacaaaattctacacgaattccccaggcccaaatatataatgtgcaaagatttgggagaaatgcagttatttccccaagtaaatatgaggaagaaaacttaactgcctctctattttagccgtctggctttaattgtgctgtgtatgccaattgtctagaccctgtggtttagaaatccagcactcgggcagtatgatacactcggaagcctgtaagagagctccgatgagctgaaggcataaactgcaaattcctcttgtagctactaaatttaaactggatttaattgtctccactggatatatcttaggtccacaaattggtggatctgtctctatgaaagaaaacaagataacaataaaaaccaaaacaggacagtcctcattcatattccattgcattaagtccaaaagccttgaggttgaaaagatgaaaaagtacttattgttgttaaaatatgagggaatgttgaacaaaggtaagaaataaagaaaagcaattatttattaaaaaataagaaatcagtttaaaattctttgtttcagcctttgattcactagtacattttattaaaatgcacttatatttctctgtagacttgtagctatatgttccatatattctgctgaacttgagagtatgcattgtttttagatttggaatctaccccttctctaaaatgtatctgtattacacttacaggcatattacatttatatatatgtatacacacatatgtactgatcatacataccatgtaccaacaaaaggttaaattatgtggaatattattggtcgcctaaaagtgtaataaattttagaaaacattttcaaatggagttagaggcagagaaaattttctgtgcttatattacatctacttatgctggatatttatccctggccagagcataaatgtatttgaggggaaaggattacttagacatatgttcctgcctccatattgcttgtgtagatagtcttccttggaaggcctacccttcttcctcttggccaatctgaatactggcattcagatcatgactagaaagaaatgttagccatcccttgaagaatatcttttgtcctaccaacctcacaaagtctttcttcattttctgcagtccgcagtgacctctcctttctctgaacttttgtgtcacctaaaatgtatataactcatttgatagctttcataaatggtctttacttttttgttcatatatatcttatctctctatttcatattacatttcagggtagatgtaggtcttatacttctctgtgtcatcattgcacctagctcaatgccttttacataaaagtataatacttataggtgataagtataatcacttaaattattgcttaatttatttttctggtatatttctttggcacataggcaatactcaaatgcttgtttaaacttagtggatagtaggaactcaactatgtttcaaatattgtttaacaaaaatttagccaaatagttctgcattttaaagaagaatatttgatagtgttatagacaaacactttaaagaaatgccattgttgcctttgactgtatctgaaagtattgtttaatattcaagcactacagtaaaagtcttggaataatttccatttttttcctcttaaaattcaaagtagaatggtttttgcctttcatatgaagaaaacagcttaatatgtagttttaaaagtatggtactttttctgtaactaccccacattaagggcttagtttcatttcaaaagacttctttatgttgcttgaaactgtgcttttcaattagtgatgcacattagacatgtgagtgctaaatatttttgccaagcattgtcctgtatttttaacacttgctttttacatagtggccagcattggctgtggattggtttgaataaaaggagcccagatttacaaggatcctggcaatggagtgatcgtacaccagtaagttaaaacgttattgttttaggtagtatggaaacactgtttgtttcaataacaagttgattgttaaataatacattgacacctaaaatttatatggaaccacaaaagaccctgaatagccaaagaaatcttgagcaaaaagaataaagctggaggccatcacactacctgagcttgaagatacacctcaaagctatagtaaccaaaacagcatggtactggcataaaaacagacacttagaccaacggaacagaatagagaggccaaaaatacatccatatatttatagccaactggttttcaacaaagataccaagagcacacaatgagaaaaggacagtctcttctataaatgatagtaggaaaactggatttccacatgcagaaaaatgagattaaacccttatctcataccatatacaaaaatcaactccaaatgaattaaagccctaaatggtaggccccaaactatgaaactactaggagaaaacacagggggaaagctccatgacattggtctggacaaggatttttttggatacgaactcaaaaacacagacaacaaaaaccaaaatagacaaatgggattacatcagactaaaaagcttctgcacaataaaggaaacaatcaacagagtgaagagacaacccacagaataagagaaaatatttgcaaattatcatctgattaaaggttaatatccaaaatacagtcgtacatcacttaacaatgggatacattttgagaaatgcattgttagttaggcagtgtttttgtgcaaacatcatagaacatacttaaacaaatctagatggtacagcctacttcacacataggctacacatctaggctttatattgctcctaggctacaaacctgttgaacatgttactgtactgactactatagggatttgtaacacaatgataacatagaaaaggtacagtaaagatataatctcgtgggaacacatcttcaagggatggctaacatttctttctagccatgatctgaatgccagtattcacactggccaagaggaggaaggataggccttccaaggaagactatctacacaagcatatggaggcaggaacatacatgtaggccatctgtggttgactgaaaggccattatgcaatgcatgactgtagataaggaactcaaacaactcaatagcaagaaaacaatctgattttaaaatggccaaatgactgaatagacatttctcaaaagaagacatacagatggccaacagtcataggaaaaaatgctcaacatcactaatcatcagggaaatgcacattaaaaccatagtaagttatcacctcccacctctcagaatgattattataaaaaagacaaaagatacatgttggtaaggatgtggagaagagggagcttttgcacactgttggtgggaatgtaaattagtacaaccattattgaaaacactatgaaggtccctcaaaaaattaaaaatagaactaaccacatgaacagcaatcccactactgggcatatattcagaggaagtgaaatgagaatgtttaagatactcggagggtgactgcagcactattcatggtagccaagataggaaatcaacctaagtgtccatcaacagatgaatggatgaagcaagtatggtacatgtacacaatggagtactactcagccataaaagggaaggaaatcctgccgtttgtgacaacatgggtgaccctggaggacattatgttaaatgaaagaagccaggcacagaaagacaaatgccacgtgatatcactgagatgtggaatttaaaaaaaaaaaaaaaggatctcatagagctaaagaatagaatggtggtttccaagagctggggcagatgaggtgggggactggggagatgttggtcaaaggatacaaaatttcatttagataggaagaataagttcaagagatctattgtacaacaagttggttatagttaatattttatattcttgaaaaatgctaaaagtagatgttaagtgttctcaccacagaaataactgtgtgagataatgcatttgttaattagctaaatttagtcagtccacaatgtatatatacttcaaaacatcatgttgtatatgataaatgcatatacttttatctgccaatttaaaaaataaaataaatacattcacgtatcatacaaccattaaaattatgtgtctttattgaaatgaaaatagagtctcatataggcagtaaggaaaagacaagttacaagtcttctttttatttttaaaaacccatatgtatagtctctctatatatagtcaaaaaattgtaaagctataaatatagtagtcatctttgggtagtatgagtgatttttttctttttgaaatggggtcttactctgccacccagggtgaagtgcagtgctgcgatctcaactcactacaaccttcacctcccaggctcaagcgatcttcccacctagcctccccagtagctgagaccacagatgcatgccatcacgcccggctaattttttttttttttttttgagacgtagtctcactctgtcgcccaggctagagtgcagtcgtgcaatctctgctcactgcaagctccgcctcccgggttcacaccattctcctgcctcagcctcctgagtggctgggacttcaggcatgtgccaccacgcccaactaattttttagtagagatggggtttcaccatattggccagggtgatctctaactcctgaccctgtgatccacccgcctcagcctcccaaagtgctgggattacaggtgtgagctaccgtgcccttccacgcccagctaattcttatatttttttgtagagatagggtttcaccatgttgcccaggctggtctcaaactcctgagctcaggcagtctacccatcttagcctcccaaagtgttggaattacaggtgtgagccacatctggccacaagtgattgttttcaaagctttctctttatactgtttattttcatttttatagtaagaagcttttctttttattatctaaatatggaagagttatacaaaaaataaaatatctttttctggggggactaggtggggatgacagagtctcactgtgtcacccaggctagaatacagtggtgccagtatgactcactgcagcctcaacctcctgggttcaattgatcctcatgtctcagcctctcaagtacaggcacatgccaccacatccagctaatttttgtattttttgtagagatggggtttcaccatgttgcccaggctggtctcgaattcctgggctcaagccatctgccaaccttggcctcccaaagtgctgggattaccagcatgagtcactgtgcctggccaaaagtatccttattggaggaaattatttgtttggagaaacctctagaaaatccttgctattattccacatttatattataaggatatattagtgtaatagttataggagcaaaattattctcagatattcaatatttactccaatttttgtcaccaaaaattggtgactccaatgtcacctccttttttattctttctaaatgtaaaactccttgagtttattttcaaattggagcatatctgagattagttaatcaaataatgagcatttcaacacatgcaaaaaaagaaaaaagtattttgcaaacctgattctctatgactccagcggcgaacttaatacactattaacttccacttctgaaactgtggcttcctttgtttggaaacttatgacattatgacatttgctaagtcctctcatgatttagcatcatgatataaaaaagagatggaaaagttttctttctgtggcatatcaacgcacttgagtgattaaggctgcctaaattacatctaaattgcaaatatttatacatcagtcttaaattctcaagcctctcttgtcttttcaggtgtctactattatcatgccaaatgagtttcagcaggattatgacatcagagactgtgctgctgtcaaggtcagtacaatgctggaaaatctgcatatttaaaacataagtccatcatcatatgcagtcaagtaacagatccatggagtgtctttttatgtgaagcatgatgttagatgcagtgagagataagcacacccatggcctggccctcagcagcctaacttacacttcatttgagaggataaaattcatattcaagaaaacctctctcattaccacgcagtaatatgctccaaatgagggggctgaggaaggctaatgaaattcagaggagaaagtgagtcccatggccatttcccaggaagaggtgggacttgaactgggactttaaggatggatagagtttctacaaatgggatagggtaaggttttttcatgaggggatggtatgagaaagtggtataaaataaggtggaagtggaagagggcagtggagaacagaatacagatcaagaagtttcattggtgctgtccttgataacagtattaggaaatcagattgatgccactttaaggaatttctacacttcttgataggcaacagggcattttttaaagtttctgagtagggagggtcacatgaactaaggagggtatgaggaagattcatcttgagacagatgtcaaaagcaacaggtaagattggaaggcatagaagaccagtgaggcatcttcctttgcagaatgcattcatgtatccatttcataaacagtccaaggagtcagtgaggcactgggtgatagaacaatgacaaggtacaaagcatagccattgtcttcacaaaactaaagtctagtaggaaataaagacaagtaaacaagcaattacaacaccactgagtaaagactatgacatgcgaaatacaagttttatgcaagaacaagaatattatgaaagaataataaggatggtgatggtgatggtccatggtggtggtgatgatgatgatggagcagctaacactgattaactcctttatgagccagccactatactaggcatgtcacatatgtcacatagcacataagcaatcttgtgaggtaggcactgttactgtattcatctcacatggaaatttgagctgtgagtaatttaccccagcttacatggagtaaatttaaactgaaagaactgaaatttacacccatgtgtgtctgggtctggtactcttaaccactatgctatatgactaggcatttatagaaatagaaagggtattgatttatgagaaaattgtatgttttagttcagatattttgaatccaagctagctataagatgtatgctatggtaagttgagatcaagagtcttgagttgaaaggaaaatgtatatttttaaaaaaagggccaagaagtggatttggaggaactgccaatatatagagtgaaaaaagatgaagatggaggagacatcagttaatatctttgatttgtagtccaagaaagagattcaacaaggtggctgaccagaaatgttacaggaaggctgagggatataagaactgacaaaaccacaggaaagcactgttttcaaagtaactcttctagtaataaactgtgtagtacatgtcatttttatagaattcccaatgtaacacaggaaaaggtgaaaacttcagagaagcttatggaatttttagtagtgttgagaacactggtacaataaactgtgttctagggaaatagagttgccaagtatggagagatttgaaaatctaccaaataaataaagagatactaatgcaacctgcatcaggaacaagcccagccagggcagtgttctgtaaggaaaatcttacctcacctgccacagaacccccagaaacttggtcttaagagaaaatagtctaagaagtgatggatgtctctcccaagtaatgccttcccctatcctttttatcctacttgctgactggaatttgtaatgagccatcctggaccatgtggagaagggcaaaatcctagaaatggcatggtaacaccagagaaggagcctgagccactgaggctggacctttatgtcgctttctgatctaatttgatcacagcttggtgcttggatacctctgaaataaatattctaacaaaaattgtcaggtgtgggggagaaaatttgcattttggacataaacatgactttacaacatatttcctttgttagcccctttgagggctcttgctcagggtattactgtttaaatattccattaattcatgtgttcatttatcgaacaaatatcttaggtgctagagctaaaatagagatcaaagtcatagggcttacagtttagtgttccataagggatgtatcaacttcaaaatattctgcaatacttttcctcttataggtatttcataggccatggcgaagaggctggcatttctatgatgatagagaatttatttatttgaggccttttgcttgtgatacaaaacttgaatgggtgtgccaaattccaaaaggtaagtggtagttattccttttcacaaccttctcatgttaacattgtgaatgcctagctcaaagtagctaggggagcattttgatctataattctgatgtctaaaagcctatgatgatgatgcaattaatatgtggagcaccccctgcctgactccggcttctaatagaaggctagcttattgaaatttagtgatatcttactctttgatcatggaagaatttgcatagaagataaaatgtgaggctcattcagggagattagattttggatgaaatattattttaagcaaaaggagaaatgcagaatcattttcgtttttattttgatgcaaaatgaaaaaataaagataatcttgggaagaataaggcagaagtcaagaaataaaaatttggcaggtccctgtaaaatttagaagcaattttcaatgaactataaaactgctaatactttatataaattcaaatttgagaagccagttagattgatagtatagcctttgataacagaagggagagtggggagaaatgtagataccattttactttactttttccaggaaaacatgaaatattaagaaaaatgttaagactttaattctcaaattattattattattttttaagacagtcttgctcagtcttccaggctggagtgcagtagcacaatcttggctcactgcagcctctgcctcccaggttcaagtgattctcctgcctcagccactggcgtagctgggactacaggcacccactaccgcacctagccaatttttgtattttcagtagagtcagggtttcaccatgttggccaagctggtctcgaactcctgacctcaggtgattggcccgcctcagcctcccaaagtgctagaattacaggcatgagccactgcacccagcctcaaattatttttaagcagagattggctgtatgaaattaattagcagaaaacccatagaaggtttttaaagaaatctctgaactgaatgtaaacagatcattgaaactaaaggtatatcctcctacaagttctcaaagaacccaaagttcacatcatggaactgcctattagaagattgttattcctaaaatagttaaaagagcttcagatgtgacatcaggtagtagcaaatctctttcacaaaggcaaactgtcaaaccagttgtaagggaaagacagttgtgttgatgggtttttctaaaggataaattatgcctaagttattcttgattattttattaaacccaaaaaagggacaaaggaaaaccagtttggatatcctttaaacaagtggaaaagtaacttgtatataattaattcggacaatgtctctgttttgaagtgttaatgtgagcctcccattactctctggcatttgttagcattccacagacagtgtcattgttccaaccaaagtgccctcgatgggagctgctgcccccacctcctgtttgagcagtggagcagaccccagagtttaaacaagggcaaccttagaaatggcaaattagccaccagaggaaatagtatgaagggcatgtggaggtgtatatatattttttttaatatatattttttaacaagagagaaaggaattaacccacttaaaaatataaatcaattaatcgaacaaatctaaataattccacctccattatccccatgcagaaataaaataaaaaactaaactcctgttctcagcctgtcccaatcacttgaagaaatcaatgattgcttgctccagggtttaaatgttatgttcacccttttttgaccgtactgtacctaactttctaagttacgatgtgatgcattcagctggttggatattttcttggttattagagcagcctaagtttactcaacttgtattcatctgtattttctggttttcttaaagaagttttcctcttatgtattctaaatcaccatgcctcttctctggctcttgcctttttattacttggttctaattaatcctctcttccctaaaagagatattttgacaacctgtaaatttgaagttacctcaaccacagtggatatttgtactttttaaatattattttttgagaaaactgtgtcaaaaataaggctcataaaagtgtttttaggaaaattacctatgatgccattacccagacatagcaatttttattgtatttcttgataccttgtacacacatacatgtttgcaatcttgtataaaaaacaccttgcatcctacttttctcactaatttaaagatatttaaaggttagccatagctttccctcccccacacacaaataatcagaagtctttgacaagattacagacaagaaactatgtacattttgaactgacttgcaacattattgttggaaattatccaatacgaatagaactggctcagagagagactaaagatgctggctattcaggcagtcctctgagtcaggtcttctgatgcctgcctgaggctcacatgccacaccaaaattaagaccagctattttactctgtaatttctaagattaagcaaatgatgtctttgacttgaagccagtgtgatctgtggccagaatgaaaagggggaggaacgcaaataggctcccatggggaacttccctgtgcctggtcctgtgctggccacttcctccagggcatcacacgtgaccttcactctctgtgagtcaggtagccatctagttttcatagaggagaaaatcaaggctcagagagggttaagccactcatccgaaataccatggcagcaaaatgcataagggcatttgcacactgacccgcccagcttccaacccggaattctgtgtagcatgccattatttactccgtttccatctgggaatcctgagtcacttttaattattttcctctcagttttgtctcatcttctcaaaaggttcaacactggagcattgtacattgtttccaaggatatcttggaagacaatgaactctatcaacctaagtttacagaacagttaacctgtttcattagatgcagaagtggttcctgaataacttcccttttcaatgaccgttattttggttcctacttcttatgcttctgtgtaacacatacaatatcattatttacttgtttttactttctaattcttagctatattttatctgtcttacttcttttgtgacctctgtgacacaaggtaaaagactgctagaaatacttcattaatatttaacgtatctgccttttggatttctcctgaagcaggtttagcatcggccctacaaaatacaactaaagtgatcaaaacgtgaagtgggttggccagaaatggacaagactcaacaatactgcaagtcctttcgagctacattaaaggccgtacttatagtataccctgatctgtcatggaatactaatgccacttgctttcttcctcatacaggccgtactccaaaaacaccagactggtacaatccaggtgagttaagaaaactgaaatttaaccaaagctgcttttaccttgtcactaatgcatttagttaattatttaagtgccagcttcttctctatacatcttcaagtgagacaaaatttctccaggcaaggaaggtgagcgactggtatgggatgaggtgatgagggtgactttttccttccctgtgagtgtaggggagtggcagagtcactggctcaggaatctcttgttccttgtagtcagtactgccccagccagagagggccggtaatctgaattactatttatagttttgaacattaactcatgcttagaggacacagtttgctttgcatagtcataattctaatctttttcttcttcttctttagaccgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatgtaatttaaaagaatatattttaaatatatttcttatttttgtatttattccatttaaaaatattacaaaaattttgccaaaatctacaaaagttaaatttttctttaatgtaaaatctgcctcacagcatccaaatttgtttcatgttagaaaaattaagtagaattgcttatgttttaaaatatacaagattaataataaatgtcactttataaggtaaacatcagtagataatatagatcattctaatttcctgtcacattttttactaaaagtcaactttatagttaacttgagtttctgtttctactaataagtaactttgcaaaataatttttgggaagaaaaataatttctgtatttttaaatttataatcaattgcaataggatactgtatgcccacttaaagtattagtctaattaatatatgcccataattacagctaccatatttcctgtacccacaataggatctgtaaatatactgagaaatttcaactactctttggcaaaaggttctagtttgtataattttgaaatctaagtaaggaatgtctggaaattttagtggttagtgattatagtaagacaatgtattcgaatcaaaaccctcaagaaagctcagcacatataaggatggatgtttggcttgtttttcagatatctggtgatggacagaagtggtggataagaattagcgagtggccaatagatgatcattttacatagtaggtgacatcattgattctacctttgtaaagttatcacttaaaagaagcagttccttttactaaatggatttctatttataagtagtttgaatattaatccataaactgcctaaattagagaaaccaagcccttttgcatgttagcatcaagaaaaaaggggtatagagtaatggtattaacattaaatttagaaataaaataacttacagtaaaaagaaaaaaatggaacacctaattacattacgagttgtcaaatctgtcattttcttttagctcacgatatccatggcaccgctttcctgtgacatttggagaggaatgcttgtacatgtctgccaagacttggcttatcggtaaagttaattctaaatcctttaatgctgattatgtaatatgtgaagttcaggttcagtttctagcttaatcttgttttccttttaattatatgtttggtaatttcatcttattctgatttattattagcaacaatagctcaaattcccaatgcaaataaaggtacttttcactgtgaatattttaacttcctttatcctaaagcagttacttagtaataaacttaccactttcctaactgataagtgtctaagcaaattttcaaagataagcaggcagcagttctaaaatatagtttaagtcccctccccctgattacattgccccttcaactctcttcctacctcctgccttcaccctgggatggtatggtagtcacacaaaatgtgtgctgtttcatagacagtattggtatgctgtaacctactgataaaaataatcatagaagacagaaatggctagagaagaaagggaatatattttaagcatttaggaaagattgatttcaagagcctttctttactactgggttgcttttaaaatgtgctgacttggccgggcacggtggctcatgcctgtaatcccagcactttgggaggctgaggcaggcaaatcacttgaggcaaggagttcgagaccagcctggccaacgtggtgaatccctgtctctactaaaaatacaaaaattagccaggtgtggcagcatgcacctgcaatcccagcttcttgggaggctgaagtatgagaatcacttgaatctgggaggtggaggatgcagtaagccaacattgcaccactgcactccagccccgggcaacagagcgagactctgtctcaaaaaaaaaaaaacaaaaaaaaacacacaaaacaaaataaaaatgtactgactgaaaaattctcaccatagtaatcctggcttttcatttctcagacttaggtaaaccaacagactgtagtaccaagttgcccttcatctgtgaaaaatataatgtttcttcgttagagaaatacagcccagattctgcagctaaagtgcaatgttctgagcaatggattccttttcagaataaggtaaaaagagaattgctacattatgcaacaatgattgcttccatgctggttttatagcctatggcagaatggcaacccattagtgacaacatcactgaaatagactctgcatgtttcaggatcccacctggccctctgtgttgccagaaaccgtggatgatatcaagaattaactctcaagttggtcatgcctacaggtcttttaaagtgcagcatttctattttgttgctactaacacttaaattgcttaagttgatctgttgagggattgggatgcattgaatagtcaggactgtctctatggccttataggaaactgacttaatttctggcttgtgttttctttttcccctcaaggagagcatccaagcagcatctgccaatcaaattagaccagcatttcacaaactactttttggggactacacacatgctacaaaatgttaatcattgatcttgcctccaaatgggggttttatgattaaataggtttgagaaatgctgcattctgtatctgcctctttgagatgcataatccatgttggtatatgtatgtattaggaaatgcatttggcttctgaaaagaggttgctacagtatgagaaaagatttattctgtcacattaaagacatttgaagataagcaggtttgtgtggaaacaccatgaagtcttcaaaatcaggcttcttttggttttgctctgccatccttaatataaggcttccgagcttaaattcagggtgttctctctagggtcttttctagaagttacccgatgagtttgtccacattgggtagcttggctcattggccactccagtctataagaaagctgaaaaaaaaattttttttgtaagatatttcaaggaacacaatttgggacataccactctacactaaagtgatcataatgtgaaaaagggaaaaaagagatgtgtctgacagctgaaagcatctgtagtaaagctaggggtacattttaactttttaaaattaggacaatctttttaattcctcaaggtaatagtactgtgttaatttgcatagctgatataaatttgaattaaaatatcctgccaagaaagagatgaatttttcaacagtgtttcttgacataaggagatgatgattaaggacacagattttgaaattaggtggaacagagtacagatactgaccttactattgtgtggctatttcacttatggatgaagttatttaatgtccctgtgcctcagtttctgtctccattgtgagaattaaatgagataatactacacaaactgcttaacacataggaagcactcaataaatgagagatctttaaatatataaagatataatataaaatatatattaaagatataatatacaatatatatcttatatataagatataatatatatatatatatatatatatatgaaagtttgaagaccgctcttcagttgtttcaattgagaaggtagcttgagcctggaagctcaaggttacagtgagctatgattgcaccactgcactccggcctgtgcaacagagagagactctgtctcttaaaaaattaaataattaatgagagcataaacttgaattcttatggtactacattgcaaattaccatatctcacagaccgaaaattagcagccctctaaaagatgaagcattttacttcctatgtgagcgttcctgtgtctggaatctcatgcttcacatatgtctttgtttgcagtgttttctaaagatcaaacccgtgtctctcacattttctcaagcaagcgatacctgtcactcctatggtggcacccttccttcagtgttgagccagattgaacaaggtactggaattatttgggaaacatgttttattctgatctggggccaggttagttttaggaggctatggggaattaacatacaaaaattcttattaaacttcttttgttatggaacagataaaagactatgttgatagataaacaaaatatattcattgacatttttaatgtatctttaatttgaataaatcaaatgctttttaaaaatctctttctaacagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatgtaagtttttttaaaaaccaatactcttcatacctctgtgaaatacttgagtctttcatacatttttggactaagcaaaaccccactgtattattccatttgtatgaaatgtccagaataggcacatctaagatagtaagtaggttagtgattgctagaggctacgggggatggaaggattgagaatagtgcctaaagagtatggagtttcttttggggatggcgaaaatgttctaagatttatggggtgatggttgtgtaactctgtgaatatactaaaaactattgaatatgtactttaaatgagcgaattgtctcatatatgaattatagctcagtaaagctgttgcaagaacaacaggtgcctccccagccttctgatggatgtactggtttttcacagtagcatcagattccatagcacttatttcataaccatataaaaccatcatgtagtgagttgtaaatagaagcaaatacagatgttttgctttacattttgggactttgggctctcagcctcagtctcctgaggcaaaaagtacaaaattggtaactggtgatcatttttccccaagagctaaatatagggaagtcagagaagggaagagggcattatactgacagtagttatgctgacaccacagtattaccgcccactgcttctgttctctatactttctggatgcagattaccttttgcacaaagggcaaagattgagaaattaacataaaagtctaattccaaaagtatgtcttagacagtaatcaactgatattcctgacataatgttactttgctcaaagttgatgttggtagcaaaggaagttctcaatcgtgagtaactatgtacaatataaatatcaaattattacttggttattatagaagatgtggaagttagagtaaacgcagcaatgaaaaatgtcaaccctaatcttaagacagtttaaacttttaagcataatctatagtaagaaatacatttaaatcaccatctagtatatagatatagatataatattaattgaaacaaaagtttcaagaaacaatacttacccttataatttatgcactctgatatgttcgttctcttctattttgttccattctcctgtcttatcctatcctttactgtccaatcctactatctcctattctgttctatttcattatcacaaatacttgccaaaatccacttaagtgatttcatgatatacgaaatgagtctcaaccatatttgagccctagactagggaattacaatgagtacttgagcatcttttcttctagggcttttccatacactgttttcttgatataagtgagatcatagtatatatactattactctgcttttctcagtttgtattatatcataagtagtttcttcagccattaaaagatctacttgataagctttttaatggttgctggggaacaggtggtgtttggttacacgagtaaagtctttaatggtgatttgtgagattttggtgcacccatcacctgagcagtatacactgcactcaatttgtagtattttatccctcacccccttcccatcctttcctcctaagtcccccaaagttcattgtgtcattcttatgcctttgcatcctcatagcttagctcccacttattagtgagaacataacgatgtttggttttccattactgagttacttcacttagaataatagtctccaatctcatccaggttgctgtgaatgccattaattcattcctttttatggctgagtagtattcctccatcatatatatatacatacatacatatatatacatatacacacacacacacaccatatataaatacacaccatatatataccgtatatatggtgtgtgtatgtgtgtgtgtatatatatatatatatatatatatacacaccataatttctttatccattcattgactgatgggcatttgggttggttccacatttttataattgcgaattggattgcacaatatttcttgattgatatgccatcatttacctaaccagtgctgggtgttaggttgtttccagttttacacaatcataaatagtgctgcaatgaacacctttgtgtataatcttagcctatatttcacattacctgcagagagattttggaagtcatgtagccagatcaaaggatataggtaatataaagctctgattaccaacttgcttccagaaaggtttatgaatttacattcctattcacagcatattgtgattgtccttctatcctcaccagcatattattaatttccaacatatatcaagcagttaagatgtgccaggcactctgctaatgtatcacatacattatttcatttaatttgcccaatagctatgaaataaagatgttacccctgccccaccttagaaaagtgaagatggagtcagtaacttgccagagatcatgcagcctatgcatgcagagtcacggttgacatctggttctgggtgggcatggtggctcacgcctgtaatcccagagactctggaggctgagagggggaggcctgcttaagccctggggttcaagtctgtagtgagccatgattgcaacactgccctcccatgtgggcaacagagcaagaccctgtctctaaaaaaaattgttttaattaaaaaatgagaaaaaaggctgggcgtggtggctcatgcctgtaatcctagcactttaggaggccaaggtgggcggattgcctgagctcaggagttcgagaccagcctgggcaacacagtgaaaccccgtctctactaagaagtacaaaaaattaaccgggcatggcagtgtgggcctgtactcccagctattcaggaggctgaggcaggagaatggcttgaacctgggaggcggaagttgcagtgagctgagatcgtgtcattgcactccagcctgggcgacagagcgagattccatctccaaaaataatataaaataaaagagagagaaaataaaattgcctttaaagagcacttggtttttaaaattcttcttaatttggtagtttgatatcgtattttcattgatctttctctgatttctaatgaaaacaaacttcaataagttaaataatcattcgtagttcatcaagtgggagtgttctttttctttgcaaatttatctatcaaacccttcatgtatttcttattgattttatgactttggaaatatcaaatatgctgatcctgtatttcttgtgtttattgcaaatactttcctaagttttctttaagtctgaatgccaaaaatattacagaaataaattttgactattttttaatatgttcaaatctgtatatttcctttttatttttcctctgttgcttttaggttagaaagtccatcatgtaaattgtaaatattagttaaatatatgtccatattttcttctagttttgtttcataggttgcctttttttgttgttttttctgacacagggtcttactctgtcacccaggctggagtgtggtggtgcattcataacttactataacctgacctcaagcaatccgcctgcctgagccttccaagtagctaggactgcaggagcgcaccaccatgcgcagctacattttctaatttttttgtagagacagggtctcattgtgttgcccaggctggtctggaacccctggcttcaagtgatcctcccacatggtccttccaaagtgctgggattacaagcaggagtcaccacacccagcctctgttttttgtgtgttttttttttcccctttctgatagcatgttacatccatggtatatgatacatgttgtcagtgcatgcttaattattttccctaatcctagccacttgttctagcatcatttattacatatactttcatttgttaaaaacaatataggcctgggctagcactttgggaggctgaggcaggaggatcacttgagcccaggaatttgagaccagagaccagcctgggcaacacagcaaaaccctgtctatgtttaaaaaaaaaagagagagaaaacaatatagcaatataggatgcctcttttatcatatattaggactgtgtgtgtatgcatatatatgtgtatgtgtatatatatatactgtattttataatatttatatcagtatggtagctatttaaaaatatttctcatatacataatgtgtgtatgtgtgtatataacatacaaatacagtcagcccttcatatccatgggttctgaatctggattcgaccaactgcaggtggcaaatatttgagaaaaaaaattttttaacctacatcctcctgtatacttaaatcatctctagattacctataatagctaatacaatgtaaatgctatgtaaatagttgttatactgtattttttagggaataatgacaaaaaagtctacatgttcagtacagacaaaaaaaattttttctcaaatattttccatctgcagttggttgaatccagattcagaacccacggatatgaagggctgactgtattgatatgttatatacacacatacacatattatatatatgagaaatatttttaaatagctaccatactgatctaaatattataattttaccatatttttaaaaactataataggattaattatactttattacatgcccttaaaacatacttttagatattcttgtccatttttccaggaaaactttagaattattagtcatttttcatccaaatagttaaaattttaaaactcttgatgagaatttgactacatgtttgggagaattgacatctttctattaatcttccaattcatgaatttgatatatctatttattcaactcttcctttagatcactctgtgaagttttatagttccatctctttctcattgtcattaacaatggcaactttagctataaaaagaatggaatcatgtcctttggagcaacatggatggagctggaggccataatcctaagcaaattaacacaggaacccaaaaccaaatactgcatgttctaacgtacaagtggaggttaaacactgagcacaggggagagggagggagggggacctgggttgaaaaactacctcctgggtactgtgctcactacctgggtccaacacacccatttaacaatcctacacatgtgcccccatatctaaaataaaagctgaaatttaaaaaaaaaaaaaaaaagaatgacagctttaaaaaatttttcttactgatttgtggggaagctattgtttgaatttgttatgggtttttttttcccccataggcatctgtctcactaaaagctctttctctctgagtttttcattagattttcttgggtttcctaagtagctaataataatatacaagcaacagtgaccctcgttcctatagttacctctctcgttttcatttcatgcctcaccacatatgctagaatttccagaatttccatggcaaataccaggagcagtagtagccaccattgtagacttgatctggacctcaacaggttgttaaacattatgttgactcttggtttaagatatagcattctataactagcttgtttagaacttttaatcaggaataagtactgggttttctaaaacttgttcccagcatctgttaagattgccatatagttttttttttttttttttttaccattaggcctatttgtacgtggtatatattagtagatattgtattaaaccattttacattcttgttgtaaaatctgggtgctcagagtggattaatattttactattctgcattatatttgttagaattttacttgggaatgtgttcctctctcttcatagagtcaatttcttatgctatattgtcatatttttttctgatcatgttagcctcataaaatgactgggtagctttccatcttttctgtgttctgaaattctgactcagcttggggaattctctttccctgaaagtttgggggaactacctacaaaatgttagaacccttatccaggagcatttttgctttttaaaaaattttaattattccttatttataattgactcataataattgtaccaatttatcaggtgcagtgtgatgtttcaatgcatgcatgtgttgtataaacaatctgatcagggtaattaccatattcctcactttaaacatttatcttttctttgtaaagataacattcaaaaccttctcttctatgtgtcttgaaatatacactacattgttctttgcagagatcatactctaatgataaaggaatttggtgcagcagtgaagggcccaagctctggagtcagattgcctaggtttgaattccagttcagccatttactatgcctttggaggtttacttaacttttcttaagcctcaatttcttatctgcaagctctaattctgttgcattaccttataaggtcaatataaggattatataagataatttatttaaagctttatcaatagtacctgacagacagtaaaaaaaaaaaaatggccattattaattttccatttccttcaaagtgattgttacattttggtatttccatttttcgttatgacaattatgctaattggcatttttcaagaaagttgtctatttaatttagattttcaaatgtattgaagtaaagttgcttatggtatttaaaaaatctccattatctttgctaacatttttagtttgcattatttacatttttacaaaaacagatgcatgttattggttttgtccactctcttctccaccctctactcctattgcttgacctgtgttataaatactatttctacctttttctaccccatttttcgtggggttctgtttttgttcattttccaatctcctatattgaattcagttcatatttcctttaaaaaaaagagaatatatttaataatacacatttggctccacataaagttttactcataccaatttttttgacatttctcattttattctttcctataattattttagttcatttttggtttactatttattgagtagcatttttttttgtcagtatctcctggtataaacttacttttcttatttttctaagtgtgatatgtttcaaacatacagaaaatgatagggataatatacttggaataaattttcatatctaatattattgattgtgattagaaaatgaaatctagatacttctgttttaatatatggagatttttatagtgactagtataggatcagagctttaaggtatattctgttatgtggtacacaacttgttacaaaaagtctataaaaatctaataagttgaattaataatcattatgttttgcttatactgtagtcgagtgttaaatattgctggaggtgttttatcttatttctaatagtttatctctttaaaaatatgtttatcaagattgccactattttgttttttataaagttaattgccctttatccatgctttgaaagtttttaaagattttctaggaaatgtcatggtcaggtccttcatggaattcttttatagggggacaaattcaatctagaatctaaacttttcttgctaggagcttcagaccattgttacatgattgcatgtatgtatttgcctttttgtttagttttttgaggaagagtctcgctaccactgtgccctaatactcaacctccaaaaatcaccgtttactgggacgtggaattttacatcctgcagtgaacgccactttgtgtctctctgtcagaaatattcaggtaacaattattatctagataactatggtactttatgctattacatatatatatatagagagagagagagtcactttctatagggagggaggggaacataggttgaaaaattacctattgggtagtatgcttaccacctgggtccaatacaccatgtaacaatcctacacatgtaccccctgtatctaaaataaaagccgaaaaaattttttaatactataaaagaatttatattaatttataatcatatggcttaaaatttcagcatggctaaatccatattgggttagtgagtcagagtttatcaaatggaatgtgatttttttaaaggatcattgccataattaattaaattaattaattgtatctgatggaatttgttaatagtagttatcccattatagtaattgaattttgttcttttttctactctggcatttttcagattttacattttattatgggaaaaggagaaaaaaacttcatatttttaattgagtgcagtattgagtattaagtccactaatagtattcactgttaaatttagcattaacaaataaacaagtgggggtttgaaacattataaacagatcactgtctatgcctttccataatccaaataaaagtagaatgcatacttaaaagtaggcatcatccatattttgaaaaatatatttttaaaaaagtattacattatttttcattgatcacaatgtgtttttaacaaatgatcaagaaaaaattttgtcatataatgagaactgtaagtagatatctcatgtgctttggcagaatttttttttgctaaattaatctttacccattttttccatgtttttaactaactcctttattagcgaagtactataaagcaataattcaaatacctcctcttgtggatggtttcttacatttcttcatgctagctctcccaggtgaaaactttgtaaggggatacttaatacatttatttccttcaaacaaaagaggtatttagcaccgacatgacatgataatgcaggttacatttatttgcagatattctcttcataaatcagaaaaatgaaacagaatgttgttctgattttagaaaacaaatgttgcagctcacacattttccttaaggtatacagcaagacatacctaattctctcacccaaaatctaaaataaataggcaaataatatctaaattagattagtatggggagaaatgtgaaaaaaatgtcccataacttgcagagtgtggggaagggtttgttgttgttgttgttttcttttacatgcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgtaagtgttcagtcccaactgccaggactgggtgatggaaagcgacattttttattgtgcatagcttctctcacagcagactaaaacaaacagaagaactgaaaatcttactccagtaaatttcatggaatatgtcggggtttttaaattttgttttgagacaaaggctcacactgtcacccaggctggagtacagtggtgtgatcacacttcactgcagccttgacctcccgggctcaagcgatcctcccacctcagcctcttgagtatctgggactgcagttacacaccaccatacctggctaatttttgtattttttgtaaagatgaggttttgccatattgcccaagctggtctcaaatgcctagactcaagcactctgcccaccttggcctcccaaaggtgctgggattaccagcatgagccatggcacctagcagcaatatgtggtttttagaggcaattatctttccactattgaaagatctagtacttcattgtttaaatgaggaaaaggttctggtggagatatatatatatttgagcacttctttttatttattctaatcaaagacgagctagaatctggagctgccatatctcttcagccaatgaaaagataagggaagaatttaaaaatcagttgtgtggaagcactatggatagtgttaaagagtcctttccatccctttctcttttttctttttcttttttttttttttgagacaggttcttgttctgtcacccaggctggagtacagtggtgcaatctcggctcactgcaacctccacctccaaggttcaagtgattctcatgcttcagcctcctcagtagctgggattacaggcatgcgccaacacgcccagctaatttttgtatttgtaatagagatggggtttcaccatgttggcaaggctggtcttgaactctttacctcaagtgatccgcccgccccaggctcccaaagtgttgggattagaggtgtgagccaccacgaccagcttccatccctttcaacatcagcagcatggctgggcaccgtggtgcacacccgtagtcccatttactctggaggcaagaggataacttgagcccaggagttcaaatccagcctggactacatagcaaaaccccagtctctagtttaagaagaaaaaattcagcaaagtaaaattaagcaactctgaaaaggaggttgaatagtgttttcctccatctcaagtgctgatcctagatagatgtctcaagcacttctcattcatttcagagcccaacaaagaatgctagtctcctactaattcgcatcactaacctctgcacatgtagcacaaaccggaatcattacacagctgaagttttggctataattaaataagggatttttaaataaagctgtggtattcctattggcattataggccacctcttttctcagccatggtatatcccaaagtataccaggatgggtctagggatgcatggaaaaaatgcgattgaagactcagaattgaactgaagaatggatggaaaaacaagaattgttatcaaaagctcaattaaaagtagcatttaggaatagcttaaagaatagtctctctgagccacagggtattctaaagttaacccagatcggccgggcatggtggctcatgcctgtaatcccagcactttgggaggccaaagtgggtggatcacttgaggtcaggagtttgggaccagcctggccaacatggtgaaaccctgtctctactaaaaatacaaaaattagctgggtatcatggcgggcgtctgtaaccccagctactcagaaggctgaggcaccagaatcacttgaacctgggaggtggaggttgcagtgagccgagattataccactgcattccagcctgggcgacagagtgagactccatctctaaataaaaaaattaattaattaattaaattaaattaacccagagcaagccaggagatggggaagctgcttactcagtcctcacagtctcaattgttttatagcattgcatttacttgctttatcttcagcattggaaattctgtgaaacgctttgttgtgtctgttgtgaggaaacaataggtgattacatttcctagtttcagtcaccctaaatcttttgagacaaaaacagtattgcaatgtagaaaatttgtcagtaattaaaagaacaaaattaaagtcacctgtaatgccagtacctaaaaataaacatgattcaatcaatattttggtatggatctttcaagttatttttctatgtgtacctatttattttttagacagttggaatcagactattttgtaactcccctccccacttaatgatttgggtcttacttcttatcctattttcaacctttacctatggttctcttttccctttcacccttaattttaacatattctgtgtagctgtttaactatatatcctaatagctgccttaattctttgaaaatgacaggatgttaataaatactttacattgaaagcaatgagaagatattgaaagattttaaacagagtagtggcaatataagactttacttaagtagacgacactgtgtggaaggccggggaggacgcaagcagctggagagagggagagcagttatttttctataaattcatgcaggaaatgctgttggcgtttacagtgtctgaggagaggcagctctgggttatgtgaagtgcagagtgtggccatgcagtgggtcactcaagtacccagcttgaagaaataaaaatacatagaattaaaggaagtcaagaaggcttggaaacatgaacacaggcatcccaagttaatggtaggaccgggaggacagcaagaattgggacatcttagtgaatgtcagggaggagcaaggcgaccaagtcctcagtgaatgtcatggggagtttgcagtgatacaaggggaataatcctgaaaggaaataaaaggagataaaaatatccactactcctttctcatagtcctgtggtatctgagaatagaatatcaaatagtcttcccctgtgggtgctgaaaggagattattcccttggaaaagccagatttatgtatttatttaagattcagggggtacacatgcaggattgttacaatacatacactgtgggatgctgaggcttgggcttcagttgaacctgtcacccaaatagtgaacacagtacccaataggtagtgtttcaacccttgctccactccctccccacttttggagtccccagacaatatcatgcccatctttacatccatgtgtacccaatatttagctcccacttatataagtgagaacatgtggtatttggtcttctgttcctgcattaatttacttaggataatgtcctccagctacatccatgttgctgtaaaggagatgatttcgttcttttttatggctgcacagtatgccatcatgtatatgtgctacatcttcttgatccaatccactgctgatggacatctagattgattccctgtctttgctgttgtgaatagtgctacaataaacatatgagcgcaggtgtattttggtagaacgatttgttttcctctgggtatatacccagtaatgggattgctgggttgaatggtaattctatttttgttttttgggaaatctccaaactactttccgcaggggctgaactaatttataatcccaccaacaatgtgtgagcattccctggaaaagccagagttaaattaagatcaattaagatcaagaatttagtgaaaagatatttatagtcttcatactttgtattcagtaaaaagataaaaggtgtgggatgatttatttagatggaatggaaattccaaaggatcagggacagggttaggtggggagtgcagcaaaggggaagaaatgcagggcagtctgaatgagtgcaggcaaagtcgcatggccgaagggccacactggaggccacagtggcttaggccctaactgggttaggttaggggctaggattacagctggaactctggtcatgaacatttcagaatgaagcagcgagtggtgttgaggcttgactgtgttgctgtttatggtttactaaggagactgtgtcgcttcgttccatatttcaaataaactagtgatgcagattgtcttgggactcaggaaagcttagctcagtgggtctgttaggccagcaccaggcccaccagtgggtatgtaaggtctctggcagcaccatggggaagctcagacaggcctgtaccccacaatccatctcctgtacctagatgggtggtcaggaccttggcagggtgtaaaggcagacgttcacagacctctagcacacaacagaatctagtgaatgaagaagcttctctccccaacaagtgtgaaaacagtgatgtgagagccacagcgcctgaagagttcagaggaagggaaccaccagctctctgtgtgccagctagcccctgggttgcgggctttacacatgttatcccattaattccagccccacgaagttaagtgtcacacttaacttggtaggggatggaaatttggagagatggcacatgaaagctagtaagtgactgaatcaggattcaaaaccatgtaggtttagctccgtagcccatattctttccactatgccaggtggtctctgatctaatcagtacttatagtgatcctcaccccattttagctttctgatttctgataaccagtggatccaattatgtgtgaggcagcgtagcataatggttaggacatagactctggggatcgacagcctggcagaaaggcccagcactgtggtttgtattctgtgggactttgcacaagttacatacctttagtttcctcatctttaaaatggagataataatagtacctctcctatatggttgttacaaggattaagtaagccaatatttgtaaagcatttagaacaatgcttgttatgtagtaaatggtatgtaaatgtgtattaaatattaaaaaaattaaaaatcattagattgaccatgggagtcaaaataatacaaagggttaacatcaatattgccacctgaaatgtacttctgctccttacaggatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaagtatgtgaatttcagatcttttaattcttaaattattaacagtcccataagtggtagaatttctgaggagtggttttataaaatctggttttggaattgtgaagaaattatagtcatgtctttttatggcaacatttgttgtgaaaatttgtattcaagtagaattatatattacatatattattattaatgggtcattttaggcatgttttatttttatgtcagctgacaatggggattaacacttaaaatcccattgttactctacctctttctgcatatatttatagttgtagaaagcttacatttgtgagaattcttttgtgattcataatatcacaactaacaggacttttatgagtcttaagattcacagcaaccacctcaagctagcttaagacaaggggaaatttaggatccccaaaacggggatagagctgaacctataactggagatgagttgacaatttctaaatttcactttgtaaatccctagagaacatctcatgaacttagcctgagtcaggtgtgcagtctctagcccagtcagaggaaagtgtttttacaactggcaaggtcacatttgtgggtctgtggtagaaagaagacactgcttcatggacaaagggacttattgtgatccaggagagatactgagtgatctctgccacatattaaatcagtttaatgtatttgagtggaatatgtttatatttgtatctttgtgaatgtatggccttttcataaaatggaaaaagatcataatcagatactgtagatgtcagattttaaatattatttttgtttgacttggttaaagcaataacttatttagaacatcaatgtttcatttaaatgttcctttaaaattaatagtatcagtagacagaaactttaaaataaattctcagagttatagttaggtgacttttaataatgaatatgtttgtacagcatctctaggggtggtcccttgtacttgacatttggtaatgcaggaagacagaaactgcatttaacctaatagcacctcattttttacattcttccatgccacagcaggggtaagaaaattgtgtcaagtaatttccttcctatagaaagctggctttttgtgtgctatatctgagtataaacagagacaggcttcaccaggatattacttctcggcttcctgaatatttcctacaaatcaagcctaatgactgcaaacaggatttaacatttatatctcaaattagaattcttaccattaactctttttctagatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgagtaagtattatattagtccattctcatgttgctataaggacatacccgaggctaggtaatttataaagaaaaagaggtttaatggcctcacagttccacatggctggggaggcctcacaatcatggcagaaggcaaaggagaagcaaagacatgtttacatggcagcaggcaagagagcatgtgcagggaaactgccctttgtaaaaccatcagatctcataagacttactatcacgagaacagcacgggaaaaacccaccctcaagattcaattacctcccaccaggtccctcccatgacatgtggggattatgggagctacaattcaacatgggatttggatggggaaacagccaaaccatatcaagtatattatactgtcattacttattgtattttgctaattaaaaaaatatttcctgtgttataaatatttctaattagcactagtaactagatgacaaaaatattcatctcctaatatctacattatcagtgacaaagtattaaaatttgtgttagttaaaatggaaagtataggcataactcctttctttactcttccattcaagaactagtctatgtttgtaaggaaggcaggttctcctttaaaaggaaaagaaatgggctaggcacactggctcatgcctgtaatcctagttctttggaaggctgaagtgggaggattgtttgatgccaaccattcaagaccagcctgggcaacatagtgagactttctgtctgcaaaaaattaaaagcatggtggcacatgcctgtaattctagctacttgggaggctaaggagggaggatctttgaacccaagaggttgaaggtgcagtgagctgtgattgaaccacctgcactccagcctggataacaggtgaccctatctccaaaaaaaaaaaaaaaaaggaagggggaaagaaatgacacacaagagagcagagaactggacattaaatcaagctaggctatggggaagtgaaaataagttagttggagcagtcaaaagcttagatacaccacaaggcagcagctaagcttaaagaagtgcacatttcacattttcagctctcaagagtcttcagataattcctatgagatccactaaggatttgtgacttccaaatgatggaactgttggaaccaatggaacaatgaacttagtgaaagttgctatagaaaatatcaaaccagtatttcccaaagcatgctccgtataacatcagtcttgagagatggtctgcaaaaagtccttagaataaggttgaaaaaaataaccaacaaaaaagaaaaaggttgagaaacactagacaccatagcttcctgttggacattaacaaatgtacattaacatatgccttaagaaatactggcataaactagtttaattttgtttaaaccaatgtttgcaaactttttttaaaatccatgtagatcttttctgaaacttccttgttaattttgtgaggaacaccctttgggaaatattaagcctttttaaccctcatactgaaaactaaggaaaaggaagatctgtcgtatagcccagcagtccccaacctttttggcactgacagggaggggtggatggtttcaggatgaaactgttccacctcagatcatcagaccttagttagattctcataaggagtatgtaagctatatccctcgcatgcatagttcacaagagggtttgcactcctctgtcaatctaatgccacagtgctctaacaggaggcagagctcaagcggtgatgctcgcttgcctgctgctcacctcctgctgtatggcccggttcctaacaggcccggttcctaacaggcctggttcctaacagtaccagtgtgtggcccgggggttgggaacccctgttatagttcatctaagaggttctaattattatagcgtaatctttgacagtatatcattactatgggtggatttataccaactgaaaaattacctttaaataggggaaagtgaagtgaatcaatgttttaaattctctactcagctactagttttctattataccataagaccaaatttaacatcaaaacatttgaaaactccttaacctattaattttagtacaatgggataattttattttacatatgtttctaattgtccaatattgtttatattttgaagtatattaaactgagaactaaaatgttttaaacttatcaaatagaagtgtactagataagtaattgttaaaattattgattattttttattcaacagatccaaaatcacatattctgagtattcgagatgaaaaggagaataactttgttcttgagcaactgctgtacttcaattatatggcttcatgggtcatgttaggaataacttatagaagtaagttgtaaatctgccaactttctctatttgtttttgtacttcattataacataattatcaagccatagttcttcaaagtacatgtctatcaatacgtgaaagtataattatgtacttagcataacttacataaataccaagacagtttttatgtctctgctctgcctttatcatcgagtttaaagttaaatggcggaaaataattttctgaattagtttgttcccgcactgctaaaaagaactacccgaacctgggtaatttatgaagaaaagagctttaattgagtcacggttccacaggctttacagaaagcatggctgggcagcctcaggaaacttacaatcatgtcagaggcgaatgggaaacaagcaggttttactatggtggagcaggagagagagtgaaggaggaggtgctacacacttttgaacaaccagaactcattagaactcactcactatcacgagaacagcaagggggaaaatcacctcccaccaggcccctcctccaagactgaagatcataattcaacatgagatttggatgaggacacagagccaaaccatatcaattttcttttttcactcttttatgtagcaactcaagactaactaaaaatgatcaccatcccatataaatcttcaatacttattttttgtttccactaactatgtgagatgagcaagaacagaatcactctattagtgttgcagttttgggtttataaccctggcttagtttatactggcccacatatgataagcattagaaaaatgagacacatggccaggtgtagcgtcccacgcctgtaatcccagtactttgggaggccaaggcgggtggatcaccagaggtcaggagtttgagaccagcctggccaacatggtgaaaccctgtctctactaaaaatacaaaaattagccaggcatggtgacgtgtgcctagttacttgggaagctgaggcaggagaatcacttgaacccgggaggcagaggttgcggtgagccaagatggtgccactgcactccagccagggcaacagagactcaagactccatctcaaaaaaaaaaaaaaaagaatagaaaaatgagacacatggtctgacaatgggctcgaatatttggaatttggactaaataccaccaatccaaaatatgattgataacaaaattttttaaaacagtctaatatagaggaaacaaggtcttgtttctaaatgcttctgagcatttagaaagatgctcagaaatgtcctgaaaatcatagacattttggaattaggaaaacctttccacggccatagagcatcaaaagcatacatttactctaaagagggtttgataaggggcacaggacaatgataaccaggggtagggaaggaaaagaagctaaattactcaaatctgcctgttttaaaaataggcttctcctttgctctctaacccatctgtttcttggggttaccaatgttttcctgaaatgtttatggttggcagaggggttaatggaaattaaactatcaagcaatagataaagacttggtttaccaagtgaggataagttcatcatagtaggacttagttggcccaaaccttttctctgatgacacttaactacccttgaattaaaatggagaaaaactagctggaaaattctgaggcttcacctgaaagtgactgaagaaacaatggtcttgtattgagccatagagaccacacccaggacagagagattgaaattgtaccctttggtatactttgtagttatattatcagaagcaactgaaaatctattataaattctgaaaaagcatttttagatcagaagactcccttattgttttaccttctttcataaaatgtttgagtaataaaatttctattaaaatatacaggcatatgagggacatatagaaagacatttcaggcaaatggcacatttgatttgaatctcattcttactgacttaatttacatctgtaagttactgttttgggttactttgatatacttatatttaattttttggcccctatacaaggaattctgtttttaaaacagctttgacttttcaatagcagggccatgaatagaaatcactgtaagtcactgtttttggttacgttgatatagaatatttaattgtatttggcacctacccaaagaagtttgtttttttaaacatttttgatttttcaatagcagggccatgaatagaaattactatgagaagccacagtatgtcaactgagagatacattaagccaagtgaaaaaagtgactttttcttaaaacaactttagaaatctaccattgcacatcatattggtcagaaaattgataactttgaagtttaggagaagggaagaggaactggaaggcatgagatgatataaagcagcaaacaagaaccaaatcgtgtgtgcagtgcttctaatgtgtcattgctgcaggcagatgtttaggggtcttgccttgggagatggtaatcaatgaagaccagaaataaccaggacaacattgggtgtgtgtaggtagtgatggcatcaatctttataccaatttataattgtaatatgcctagcacctttttttaaagctttattgcaatcatcactaccccaaaaagaaacacaatacccactagtattccctccctgtctcctagtcctcagcaaccactgatctactttctgtctctacagattgcctgaatgtaaaattctggacattttacataaatgaaatcataccatgtgtgctttttgcgtgtgactggctttttccattaagcataaagattttaaggtttatccacattgtagcatgtatcagtacgttattcctttttatgactgaataaaattccattctatggatataatacattttatttatccatgtatcacttgatggacatttaggtaaaacaacctaaattttaaaccatttttaattattatgtataatgcttctctgaacattcacgtacaagtttttgcatggacatatgtttccatttctcttgggtaaacccctgggaatagaattgctgcatcttttgtttaaccctttgaagaactaccaggttgttttccaaaccagctataccattttccattcccggtatatgagagtactgatttctccgtatcgatgccaacatttgtgtgtttttcattatagccatctaagtgagtgtggaatgatatctcactgggatttttatttcatttccctaatggctaatgatattaagcatcttttcatgtgcttattgaatatttgtatatcacctttggggaaatccctattcagattttttgctcatgttttaaattgagtctttttattgtcgaggggtaagaattctttatatattctggatataaatactttccagtatttatatataaatatataaataatttccaaattattttaaaatttatataaaatataaaattttatatttctggatataaataatttccaaatattttctcccatgactttacttatgccacaaaagtgtttttctttttttttcttctttttttattgtactttaagttctggggtacatgtgtagaacgtgcagttttgttacataggtatacacatgccatggtggtttgatgcacccatcaacccgtcacctacgttaggtatttctcctaatgttatccctcccctagccccctaccccccgacaggcccagtgtgtgatgttccactccctgtgtccatgtgttctcattgttcaactcccacttatgagtgagaacatgcggtgtttggttttctgttcctgtgttaatttgctgagattgatggtttctagcttcatccatgtccctgcaaaggacaggaactcatccttttttatggctgcatagtattctatggtatctatgtgccacattttctttatccagtttatcattgatggacatttgggttggttccaagtctttgctattggaatagtgccacaataaacatacgtgtgcatacatctttatagtggaatgatttgtaatcctttgagtatatacccagtaatgggattgctgggtcaaatgatatttctagttctagatccttaaggaattgccatactgtcttccacaatggttgaactaatttacagtcccaccaacagtgtaaaagtgttcctatttctccacatcctctccagcacctgttgttcctgactttttaatgattgtcattctaactggcatgagatggtatctcattgtggttttgatttgcatttctctaatgacgagtgatgatgagcattttttcatgtgtctgttggctgtataaatgtcttctcttgagaagtgtctgttcatatcctttgcccaattttgatggggttgtttgtttttttcttgtaaatttgttgaagtttcttgtagattctggatattagccctttgtcaaatggatagactgcaaaaattttctctcattttgtatgttgcctgttgactctgatgatagtttcttttgctatgcagaagctctttagtttaattagatcccatttgtcaattttggcttttgttgccgttgcttttggtgttttagacatgaagtctttgcccatgcctatgtcctggatggtattgcccaggtttccttctaggatttttatggtcataggtcttacatttaagtctttgatccatcttgagtttatttttgtataaggtgtgaggaaggggggtccagtttcagttttctgcatatggctagccagttttcccaacaccatttattaaatagggaatattttacccagtgcttgtttgtgtcagatttgtcaaagatcagatggttgtagatgtgtggtgttatttctgaggcctctgttctgttccattggtctatatctctgttttggtaccagtaccatgatgttttggttactgtagcctcatagtatagtttgaagtcaggtagcatgatgcctccatctttgttcttcttgtccaggattgtcttggctatccgggctcttttttggttccatatgaagtttaaagtagttttttccagttctgtgaagaaagtcagtggtagcttcatggggatagcattgaatctataaattactttgggcagtatggccattttcacgatattgattctacctatccatgagcatggaatgtttttccatttgtttgtgtcctcttttatttccttgagcagtggtttgtagttctccttgaagaggtccttcacatcccaggtaagttgtattcctaggtattttattctctttgtaacagttgtgaatgggagttcattcatgatttggctctctatttgtctgttattggtgtacaggaatgcttgtgatttttgcacattgattttgtatcttgagactttgctgaggttccttatcagcttaaggagaatttgggctgaggtgatggggctttctaaatatacaatcatgtcatctgcaaacagagacaatttgacttcccctcttcccatttgaatgcccttcatttctttctcttgccagattgccctggccagaacttccaatactatgttgaacaggagaggtgagagagggcatccttatcttgtgccagttttcaaagggaatgcttccagtttttgcccattcagtatgatactggctgtgggtttatcatgaatagctcttattattttgagatacgttccatcaatacctagtttgagagtttttagcatgaaggggtgttgaattttgtcgaaggccttttctgcaactattgagataatcatgtaatttttgtcattggttctgtttatgtgatggattatgtttattgatttgcatatgttgaaccagtctttcatcccagatatgaagccgacttgatcctggtggataaactttttgatgtgctgctggattcggtttgccagtattttcttgaggatttttgcatcgatgttcatcagagatattggcctgaaattttctttttttgttgtgtttctgccaggttttggtatcaggatgatgctggcctcataaaatgagtgaaggaggagtccctctttttctattgtttggaatagtttcagaaggaatgttaccagctcctctttgtacctctggtagaattcagctgtgaatctgtctggtcctggacttttttcggttggtaggctattaattactgcctaaatttcagaacttgttattggcttattcagggattcagcttcttcctggtttagacttgggagggtgtatgtgtccaggaatttatccatttcttctagattttctagtttatctgcatagaggtgtttatagtattctctgatggtagtttgtatttctgtgggatcagtggtggtatcccctatatcattttttattgtgtctatttgattcttatctcttttcttctttattagtctggctagtggtctatctattttattcatcttttcaaaaaccagctcctggattcactgattttttgaaggttgtttttttgtctctatcgccttcagttctgctctgacgttagttatttcttgtcttctgctagcttttgaatttgtttgctgttgcttctctacttcttttaactttgatgttagggtgttaattttagatctttcctgctttctcttgtgggcatttagtgctataaatttccccctacacactgctttaaatgtgtcccaaagattctgatatgttgtgtctttgttctcattggtttcaaagaacatctttatttctgccttcatttcgttatttacccagtgtcattcaggagcaggttgttcagtttccatgtagttgtgcggttttgagtgagtttcttaatcctgagttctaatttgattgcactgtggtatgagagacttatgatttccattcttttgcttttgcttaggagtgttttactttcaattatgtggtcaattttagaataagtgcgatgaggtgctgagaagaatgtatattctattgatttgggctggagagttctgtagatggctattaggtccacttggtccagagctgagttcaagtcctgaatatccttgttaattttctgtctcgttgatctaatattgacagtggggtgttaaagtctcccactattattgtgcaggagcctaagtctctttgtaggtctctatgaacttgctttgtgaatctgggtgctcctgtattgggtgcatatatgttttggatagttaactcttcttgctgcattgatccctctaccattatgtaatggccttctttgtctcttttgatctttgttagtttaaagtctgttttatcagagattaggattgcaacttctgctttttttttgttttgttttccatttgcttggtaaatattcctccatccctttattttgagcctatttgtgtctttgcacatgaggtgggtctcctgaacccatctcatctgaacagcacattgatgggtcttgactctttatccaatttgccagtcgtgtgttttaattgggggcatttagcccctttacatttaaggttaatattgttatgtgtgaatttgatcctgtcattatgatgctagctgattgttttgcatgttagttgatgcagtttcttcatagtgtgaatgttctttacagtttggtatgttttgcagtggctggtaccggtttttcctttccatgtttagtgcttccttcaggagctcttgtaaggcaggcttggtggtgacaaaatctctcagcacttgcctgtctgtcaaggattttatttctcctttgcttatgaagcttagtttggctggatatgaaattctgggttgaaaattcttttctttaggaatgttgaatattggctcccactctcttctggcttgtaaagtttctgcagggagatctactattagtctgatgggcttccctttgtgggtaacctgacctttctctctggctgttcttaacattttttccttcatttcaaccttggtaaatttgatgattatgtgttttggggttgctcctctcgaggagtatctttgggttgttctctgtgtcttctgaatttcagtgttggcctgtcttgctaggttggtgaagttctcccagataatatcctgaagtgtgttttccaacttggtttcattctcctcatcactttcaggtacaccagtcaaacgtagatttggtcttttcacatagtcccatatttcttggaggctttgttcattcctttttattcttttttctttaatcgtgtcttctctctttatttcattaagttgatcttcaatccctgatatcctttcttccgcttgatcaattcagctattgatacttgtgtatgcttcacgaagttctcatgctgtgtttttcagctccatcaggtcactaatgttcttctctacactgggtattctagttagcagttcctctaaccttttttcaaggttcttagcttccttgcattgggttagaacatgctcctttagctcggagcagtttgtaattacccaccttctgaagcccacttctgtcaattcatcaaactctttctccatccagttttgttcgctagctggtgaagagttgtgatcctttggaggagaagaagtgttctggtttttggaattttcagcctttttgcactggtttctccccatctttgtggatttatctacctttggtctttgatgttggtgaccttcagatggggtctttgagtggacatgctattcttttctgttttttagttttccttctaacaggcccctctgctgctggtctgctggagtttgctggatgtctacccgactctgtttgcctagttatcacccacggaggctgcagaacagcaaagattgctgcctgttctttcctctggaagcttcttcccagaggggcacctgcctgatgccagccagagctctcctgtatgaaatgtctgtcggcacctactgggagatgtctcccagtcagaatacctgggggtcagagacccacttgaggaggcagtctgacccttagcagagctcgaacactgtgctgggaggtccgctgctctcttcagagccatcaggcagggatgtttaactctgctataagtccctgactgtggctgctgcccttttttcagagatgccctgcccagagaggagaaatagggccatctggccacagcaaccttgctgagctgcagtgggctccacccagttcaaacttcccagcagctttgtttacactgggagcgtaaaactgcctactcgagcctcagcaatggcggatgccactcccccgaccaagctctagcgtcccaggtcaatctcagactgctgctatgctggcagcgagaatttcaagccagtagatcttagtttcctgggctccataggggtgggacccacctagccagaccacttggctccctggcttcagcacccctttccaggggagtgaacagttctgtctcaccggcattccaggcaccacttgggtatggggaaaaaagaactcctgcagctagtttggtgtctgcccaaatggctgcccagttttgtccttgaaacccagggccctggtggggtaggcaccagagggaatctcctcgtttgcaggttgcaaagaccctgggacaagtgcactatctgtgccagagttcctcaggctcagtccctcatggcttcccttggataggggagaaaattccccgaccccttgcatttcacaggtgaggcaatgccccaccctgcttcagctcgccctctgtgggctgcacccactgtccaaccagtcccattgagatgaacccggtacctcagttggaaatgcagaaatcacctgccttctgcatcaatcttgcttggagctgcacactggagttgttcctatttggccatcttgccagcaatccatcacaaaagtgtttttcttttgtcatttgtgcatatgtaagaaggctttgcttaccccagggttatgaagacttactcctatgttttctttcttttcttttctttttttttttttgagacagacttttgctcttgtcaccgaagctgaagtggtgcagtggcatgatcttggctcactgctacctctgcctcctaggttcaagcagttctccagcctcagccttctgagtacctggtattacagacaaccgccaccacgcccagctaatttttgtatttttagtagagatggggttttaccatgttggtcaggctggtctcgaactcctgacctcaggtgatctgcccacctcagcctcccaaagtgctgtgattacaggggtgagccaccatgcctggccttccatgttttcttctaaagattttatagctgtagcgcttatatttatgtctgtgatctactttaatttttgtgtgtggtgaaagaaaggggtccaacttcattttttttttttttttacatgtggatatccagtttagaagactattctttccacactgaattgtcttggcatccttcttaaaaatcaattgactggccaggcacggtggctcatgcctataatcgcagcaatttgggaggccaaggcggatggattatgagatcaggagttcaagacctgcctggccaagagggtgaaaccccatctctactaaaatatacaaaagttagccagccgcggtggtgggcacctgtaatccctgctactcgggaggctgaggcagagaattgcttgaacccaggaggtggaggttgcagtgagctgagatcgtgccactgcactccagcctgggtgacagagtgagactgtgtctcaaagaaaaaaaatattaattgaccataagtatgcacaactgtgaacagtttatgtccagagaagagatttctgtggtgacttttataacttatcaatcatgttttaaataaataaaatagttatgttcatttccatgcaattaaacgtatatgtaagagaaaataatatttttttatttcaataggtttttggggaacaggtggtggttggttacatagataagttctttagtgttgacttctgagattttggtgcacccatcacacgagcagtgtacactgtacctagtgtgtaatcttttatccctcatcccctcccactcttccccccgagttcccagagtctattgtatcattttatgcctttgcatcctcatagcttagctcccacttggtgagaacacacaatgtttggttttccattcctgagttacttcacttagaataatgatctccatttccattcaggttgctgcgaatgccattatttcattcctttttatggctgagtagtattccatggtacatatataccacattaccacattttctttgttcacttgttgattgatgggcatttgggctggttccatatttttgctattgtgaattgtgctgctataaacatgcatgtgcaagtatctttttcatataatgacttcaagaaaagaatatttgatgacaaaaatgaaatgttattactgaaggatggtggaattataggtcaatatttatagtttgtatttatattcaaattaaaaatgagcatgatttactgttataatcagaaaatatcttaaagggttatacataatcatacaaccttttagaaggttgggaaaagagaaaattagtcaagtttgaaatcttaactgtataagtgtaattcaagtcttgatttaatctctaagcataggaaaaaatgtttcttctctagataagtctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatgggtaagtatagtaaaatatagagttttctttcactccagggaaagaatataaggctattagttccaccagtgggaatcatacaatcaaatgcttcctctgtattcagtcctgtgcgaggtgttacagaggttatcgaggaaggaaaagatacgggccctgctgtcaaggttttgaccctaaggagtaaaatgtagttgtggagacagcattaaattccttatcattgtttaatgtaaattggtcttagattaattgatacaggcttaaattgtggggaagtcaaaaccgatacattggaaaggggaataacaaaaaaaaaaggaaaggcttcaagaagaggtgaaacttggttggggtttgaaaaatggatagggtttatataaataagaaagtgtttggggaacgagttttaacattccgtgcaaagtgaatgtctctccaccttgcttaatctttaaataaatctatttttaaatatatgttagttttaattttttcacagcttaaaaactgttaattattaccactgtgccctaaaactgtcattactcccactgtgcccaaagctccctgctcactgggagcccgtaaaggtggagtgctggctagttggctcacttacagcgccgcagtcacttcccaagaccgtgtccaccagcaacctccagggattccttattctaacctactttgagtgcatgtaaacttttgagacattttagaaacttagtctctatccccagtttctaggccttctcccagttccctgtttttccccattcttgctcagcaaagcatctttttctcaatcaagctggtctcttcattgtcccaggcacagtgtatgcccatcctcatacttgcacctttatgttttccttctgccaagaagttttccaatttctttctttctttattttttttacatctttaataaacttttcattttaggatagctttagagttacagaaaagttgcaaagatagtacagagcattcccatctaccctacaatcaatttcccctactgttggcatattactttagtatggtacatttgtcacaactaataaaccaatatttatccattattatctttaactaaagtccacacattattcaaatttctgtagtttttatttaacatactttttctttctaggatcccacctaacctttagttctcctgcctccttaagctcctcttggctggctgttttctcagacttttcttatttttgctggccttgacagttttgaggaacactggtcatgtatttggtagaacgtccctcagtttgggttggcgtatgtttttctcatgattaaactggggttataagtttttgagggaagaccaaagatgtgagggagcattctcacttcacatggacagcatgtactattcatatgacttatcactggccacctggcccaaggtagtgtttgttaggttctctgctgcaaagttacctcttttcctcctttccatactgtcttctttccaaggaagtcactatgttgagtccacacttaatagggtagaaagttatcctccaccttcctatgaggggagtatcgatataaattacttgaaattcttctgcacaggatatttgtctattttctccaatttttattttattttattattttatttatttatttatttttttggagatggagtcttgctctgtcacccaggctggagtgcagtggcgccatctcagctcactgcaacctctgcctcctgggttccagcgattctcctgcctcagcctcccaagtacctgggattacaggcacgccccaccatgcccagctaattttttgtatttttggtagagacggggtttcaccatgttggccaggatggtcttgaactcctgacctcaggtgatccccccgccttggcctcccaaaatgctgggattacaggcgtgagccactgcacctggccccaatttttaaatttattcagtcatttatttataccctcatcattgtagtttttttgttatttgtttgtttgtagcacttccatactttctccttaccttctttttattcttgatttcccccaatcctctagacctagtataggttcattgttatttattttatactttggattataatctaacatactgcattctgtaatattttgcttaagtctttccagctttggcccttgggagctctttcacttggctcccatgtcccttgaaataacctcgtcattgtggctttgctgtttgtgcttgttttaagcacttccttactttctggttcccttatttctttttagtcttaatttcacctaacccttgagacctggtttatcaagtagtcttcctgactcttctcattcaaatgaatctctaccaatttcacataccctactggttaacagttttgccatcatttcagccattgttgtttctgtctccaactaatatatgagcttcttaaatcaaagaaaatgtttatgccttttaaaatatcaatcagagaactttaagagcctaagatatgtgtcataccagtaagaaaaataaaatatacatttgacctcccttattaataagaaacccagttttatttaacttttgaaatgattgcatgttgtctcatccaaaagatgtatttgaaataatttaaattttaatcaccagtgcttttaattattatagttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatgtaagtcttgcttcgttttccagaaacttttcaaatgtgttattttgagggttagaaatttgagcgtaaagtattaacacaaagtacaacattagatgaagtactgggactccgcttgcatagcatggtgctttcttaccttttacaacacagaacaaatagaaaattttactgtagcatgcactaggacaaatgatcaggccatcccaagggcccagtggatgactatctcaacaacacctctatagcctatttgggacagacaaattggaaagctgataaaaatgaaatagcatagaatcagaaaaccctgagtttgagtaccagtagcagatcttccatttatgtgctgggtgatcattaacctttgcaaccttatttcctcatgtagaaaatcagggtaataataatttcactgagattttaacacaaaagtttatacaaagtaccatctaaaattctccacatggttaggactaataaacgtataccttcttcccacttttcctctagaaaattatactacttaggattaattctgctagtaaagacatctgtgccactatttgaatcatattatttaatcatttatgtacttacagtagggtcttgtgtacaaaaaatggttatctattgagactagagttgtagttttaatttaaataatctttagaacagagtggggaagatttttttttaaaagcatggcaagttaagattataaattcaaggaaaattcaaaaatagtcttcccattttgagtttcttgggaagtgtttctcttttctagctccctactgcttggtgtcctctgtagtgtgaaaaatgtagccagagacacaaaacacaaaactataaaacacagaaaacaatattcagaacaatatgaaggttgggattgtaaatttgtaattatgacaaatggaagccatttgcatgttgtttaatttcgagtgtcacataaactcatccttcaaaaaaatctgaagaccaggtgtagtaactctgtctgtaagtttaaagttctccataaactgtatcagagcaaatgtcccaaatcaatgcatcagaagtaaatcagacctacaataatagtaggttcagacctacaatactgtaagcaaataattaatattccattataatatttcttaaagtatgtatgttgttctttgtattctttttgaagtcaaacatctggattcaggttatctctattgttcttacaacagggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatgtaagacttcaatttcagtaacagtacatttatgaaaatgtgacataatttatgcacataattaaaagctcagtggaatttttatttaaagatttattcacaagggccgggcgcagtggctcgcgcctgtaatcccagcactttgggaggccgaggcgtgcggatcacgaggtcaggagatggagatcatcctggctaacaaggtgaaaccccttctctactaaaaatgcaaaaaaaatagctgggcatggtggcgggcgcctgtagtcccagctagtcaggaggctgaggcgggagaatggcgtgaacccgggaggcggagcttgcagtgagccgagattgcgccactgcagtccagcctgggagacagagcaagactccgtctcaaaaaaaaaaaaaaaaaaaaagatgtattcacaaataatttttgtgaaaataattttgatactttgtaaatggaaacaaatacagtataagcactcagggaatttattcccaatgactttcatttgttctgtcaccaggtaaattctaccctagaatttgtgaattctaatttcacttagcaatgtttttcaaaggctgagatgcttatttcaaaaaagggtcccacaacatataaatttggggaacacctcatgtgatttaccgtattaaagtttctaagagagtttcttttcttttcttttcttttcctttcttttcttttcttttttcttttcttatcttttctttttctttttttttttttgacagggtttcagctctgttgcccagactggagtgcagtggcatgaacatggctcactgcagccttgacctcctaggctcaagcagtcctcccaactcagcctcctgagtagctgggaccacatacacatgccaccacacccagctaatatttaaaatattttgtagagttagggtctcacaatgctgttcaagctggtcttgaactaggatcctaggctcaaacaatcctcctgtttcagcctcccaaagtgctgagagtataggtgtgagctactacgcctggccaaaggttctaagagagtttctgtaataatgaagtctgtttaactttgtgtaaccaagcattttccaaatttatatgatccttaaagtttaagggaagagcctcttccattagaggctggacttagggtcacccctggtggataaagcatgaaccttgaggaagaccacaaaaaaacaaactaccggggactgcagaggcctgcaggacaggctggggggtggtggcattggtttccgaagactctggttctcaatgctcaccatgttttctgctctgaagaatcttgaacggcagattcaacatttggttgaacagattcaggccgaagaaaatgtgaaaactttagagaagcaggttaataaaagaaagggagaatgatataaaggatgaggaatcaaggtacaatcaagaactgacttctcagttgttaggcacagaaaacaaatgtaactctttagaaaaacaattggaatacatgagaaataaggcatgcagaaatagagaaacaggctttataggatagagaatgataagatggccagacataagttctgtgctctaccaggttgaagagtgcctcctccccaaagattcccgtccagtcagaaccttagaatgtgactttactgagaaatagtctttacagatctaggtagttgaggtgaggacatattggataatggtgggccctaaatccaatgactagtgtccttataagagggagatacagacacacagagggaaaaagtccacgtgatgacaaaggctgagattgcagtgacagagtgataaaccaaggactgtcggcaaccaccagaagatgagagggaggcacgagacagattctccaatacagcctccaatgaaaaccaatcctaacaccctcttcaattcagacttctagcctccagaactgtgagagcatacatttctgttgttttaagccaccaattttgtggaatttattatggcagcccaaggaaacgaatacaagggctaactttaaaaactggatcttcaaaaaaaaaaaaaacaaaacagagaataacaggcattagtgaagatgtggagaaaatggaacccttatgcactgctggtaggaatataaaacagtgtaaccactgtgcaaaatggtgtggcaattcttcaaaaacatgtacataagattactatgtgatccagcacttcaggtatatactcaaaacaactgaaagcagggattcaaacaggtgtttgtacaaccatgtcatagcagcataattcataatagccaaaagatgaaagcaacccaagtgtccatggatggacgaatggataagaagccttaaaaaggaaggaaatgctgatgcatgctgcaacacagatgaaccctgaagacagtatgctaagtgaaataagccagtcacaaaaagacaaatactctatgattccatttatatgaggtagtacccagagttgtcaaattcatagagacaggaagtggaatggcagttaccagggactagatggaggggaatatggggagttattgtttagtgggtatagagtttcagttttgcaagataaaaaattttagagatgggtggtggtgatagttgtacaacagagtgaattcatttagcaccacgggactgtacacttaaaaatggttaaggccagatgtggtggttcatgcttgtaatctcagcactttggggggctgagacaggtgggtggcttgagcccaggagttcaagaccagcctgggcaacacagtaagactccgtctctacaaaaacgtgtaaaaattagctggacacagtagtacatgcctgtaatcccagctacttgggaaactgaggcaggaggatctattgcacccaagagtttgagactgcagtgagctatgattgcactactgcattccaacctgggtgacagaataagaccctgtctctaaaaacaaaacaaaaccaaaatggttaagatggtaaattttatgttatgtgtattttaccacaattaaaaaaaatggatcttcttgaacaggaatgtaacacacttaccacgatgcaagcccttacagaaaaaaaaaaaaaaagagttggaagcaaaacttcatgaagaacaagaagaaaaaaaaatgtacgcagcctaagagaccccagttgcagactatactagaaacaaatagaccaaagataaggcagttccttatgttgccagtgcaagaagtaatgttaaaaaaaaaaaggtcaaaccattcagaaaagttccctatcctaatgatgccataataatcaatgttcaacaagttttgcattaacaattgagcccagtgcaacaatgagtaatcagcaatatacctttgcccaaccaactattttcataaggtggtaaaaacaagaacttactagtaacatttcttttcaacagcagcattgatgaggagttgtgagaagttttatagattgtatagatgaatttggcaaatgcattttgatctgcagcagctgggaaacttacccaggagtccaactgctgaactgaagacttagtactcaaattggtgtgttagtgagaagaatggaggcaaaagccaatcaaataaccgaagttcaaaaagatcaagtctggtttctaacagaagatagagaagcagcagaaggaactaagggccactaaagagtctcacagtagccgccattcctctctaatcacagagaccacaaataaggactctgccaagtggagatttggagaaaaaaacagaaaaagcctttacttactgaaggacataaagatcatacagaatgcattacaaaacaatagtttgggttgagattactgactggtaccaggtcagatatttgattcagataagctgtaccgcactaatacgacattgacaatttactttccagttttcatatgctcttcggttggaattaaaaacaggtgttaaagggcacaagctgcattcctcaggctgcttctgttactcagcacaattaaaaatcaatttaaatggaaaccaggggcatttttaagagctaagaagccactcctagtctttttttgtttgagtgatgttgcggtgctgatgtattatgctttgtaaaacaaattagctatttttaaaaaatagttcttcttatgactaagtaaaactagatttatttagattatcaaaataaaaaggaatccaacgggctaggcgctgtggggtcacgcctgtaatcccagcactttgggagcctgaggcaggcaaatcacttgaggtgaggagtttgaaaccagcctggccagcatggtgaaacttcgtctctactaaaaaaaataataataaacaaaaaaaggaatccaaagaaagaaataattttaattattatttcagagtactttcaggtctgcctggcctgtctttacttctttttctagtctgtctttctcattgtttctactttagtccaaatcagtcttagaaagctaaggcactttccacttctatcacctaggttttttaaacggtattccaaaaagttaattaaaatatgtatttatagagtgtgggctgtggctttctctggtatgagttaaatgctactcaaccacaaacgcaacagttccaatcagggacattgaagtagattttgaaaggcagtcttttttttccatgcattgttacaactgtgtctaacatttttatagctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatggtgagttaaaatttgttgattttcttatgactcaataatttttagaaatgtttcttaaggatataatttgaagcaatgattgtatttttgaaaatatttttaaagcactttccatttctaatagcgctataaactaattgcccagtggtagggaaatggttaagtatctgatgacataggaactcaatgaaatattggaatagccattaaaaacgcctgtaatcccagcactttgggaggccaaggcgggcagatcatgaggtcaagagatcaagaccatcctggccaacatggtgaaaccctatctctactaaaaatacaaaaattagctgggtgtggtcgcacacacctgtagtcccagctactcgggaggctgaggcaggagaatcgcttgaacccaggaggcggaggttgcagtgagctgagatggcaccactgcactccagcctgggtgacagagcaagactctatctcaaaaaaaaattatcaatgttaataataagtacatggaaaataataagttggaagaagtagaattttaaagtggtggctgggtgcggtggctcacgcctataatcccagcactttgggaggccgaggtgggaggatcacttgaggttagccattaaagactagcgtgaccaacatggcgagccctcgtctctactaaaaatacaaaacttagctgggcgtggtggcgtgcacctgtaatcccagctacttgggaagctgaggcaggagaatcacatgaaccagggaggtggaggttgcagtgagccaagactgtgccactgcgctccagcctgggcgacagagcaagactccatctcaaaaataaataaataaataaaataaataataaaaataataataaatgtaaaataataaaataaaagtggctaagtgaactgctaagtaaaaatactgacaaatgattggaaacggttttacctatagctagatatgcttagaaaaaggaattaagaggtaaaatttttgtaaagttagctaagtagtaaataaaaattatagttgttccattgcttagttattaatacataagcttagcctcaccagggtaacaaatcaaagtagtatggttgtccatccgttctgcaataggattggccacatcctctgaccaccataaagggcagtgctttttgccttcagatttagctattttagaaagagtagcaatgattggctctttcccgtgacaaatttgatccatagtcaaactgtaaaatgacttctaggggaactacctagagtatttcaaagaccaaaacttgtttacctgcttccttgggtagcaaattagccaggtagatggatggcatttatctaatttattctgataaccgttgtggagacacttgactgattgaaaaatcttgtagttaccgggaacttttgtgtgggaaccattcggttttatacctgaatacacatgatggaaactgttgtaagatatatgtatgttttgaaagtcataaacctttttctcctaaaggagaaaacagaatggtttactgtaaaactaatatgtaggttaagcacttaagacttggaggcatgagggtctgggttcaaatcccagttcccacatatcctagctaagtggcattgggaggttacacaactctttctcttttctcatctgaacagtcagagaggtctcaggggtaggcagttccagggccaaaaaaatattgccagataaatattttgaagaaacacaaaatttctttatacgtgtttggaagtaatttttttgaagtacttataaaattttgacctaaataccagtttttaaaaactgtctctgtgtaaggcttgaatttatcaatgatcttgttaataatatatgtatttttcaaatggctagttgagaataaactacttctctagtttccataaagctaattgagaatgtgttttctttcaacagatcactctgcaactatcgtttccataaaagatgaagatgagaataaatttgtgagcagactgatgagggaaaataataacattaccatgagagtttggcttggattatctcaacattctgttggtaagtgaaataattgtatgtgtagtgtgcaaagagagttctaactcatcctaaataacaagtcgtccttgctaaagaatgttaagtagtggctaattcagatgcctcttctggataaataagctaggtcgctggctgttctggatggttataaattttgaatgaatccatgagttaacttagcaatgacggaaaccactaatgacacagaaaatcctgttaaataaagtggaatctttctagaggcttatttctgggatccttggatcaacatcaggacattttcttctccacaggaatgtctgtgtccccacaaggaacccatgcctgccttctcttagagttctagtgcctgtcaccgcatggatttgcagcttataacttcgttattcagaaagttatcttcttgttattcccttctctctaagaatatttttaccactggttaaaattatgtcttaatagtaatctttaaaaactgtcttagtgttaggttggtgtgaaagtaattgcagcttttgccattacttttgcgccaacctataaaattgcagataattgattcaaagaaaatttgtggaaggattttttaatacgaaatagtagatacagggtttaggtgaacttggaattggtagaaataagagtacaaatatgacagaagataaggtttttcacattttatgcaaagttgaattttaaattattaaaatgtgaattttaaaatgttaagtacttgtcaaaaaataaaaggattccaagttgtccatctaaatgaatcctaaatcgtgtttacactgtcaccacaaggtggtgccacttcagctggaaagcaaaaatggagtcctggtggtggtgtgggagaaaggtggggatggagattcctgcacccttcctcttccaccagcatatctttaatgatatgactttttacaattagagtaggggaaggatatgggtccttagaaatctctccctcacaaaataaatgtgcaagcattctgcactttaacggaaacaccacattctctatctgtgttgtccaatagaactttctacaaagacagaaatgttctatatctgcactgtccaatatagtagtcactggccacatgtggctcttgagcacttgaaatgtgactagtgcaactgaagaactgattttatttttttcatttttaatgcattttattttaacaagtggctctcatattggacagcacagttctgatgagttacatgaacccatgcttgtaacttactagtttagtggcagtagacatagttgtatttaatttctttcttcagaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggtaagtatggaacctgtccttaggagactttttgcagaacagtcaggaaataaatgtacaatccaattatgtacaaaattctgtatttagtcttgaagtatttagtccttaaagtatatccaactatcttgattaagtcatagagatttccccctgaaaaatagattacaagggacgataactgcacaagatgtccaggactccagtctacattttatataattctttcctaagaaaaacagaagttgccagggtattagggaagtaatttcttttaaaatgttcttgagatgtattttattctatagtttgattatataaaagcttaaaggtctatttctgcagttaatttgcttcctttcttcctaatcccataaaactcatggttaattttaaaacaatgcaaaactggatttagttattgaaaacattcagggtatctataaaaaatcataatttgaacttacatttcattatgaattgatacataaaattaccattaaaatgttatattaacttcatttctggagaaagagctccaaatttttcacagtaacatttttaaagatcttgcataaaacttttgcttcttgtatataaatattaaagataaaacctcaattctaggtaatcagtatccatgtatacacacactgagacagtaaatagagtgtctactatatgccatgccctgttttgcacactgggatgcacctgagaacaagacagataaggtacctgttctcacagagattacaatctggtgaagaaagataagtaaacaggtcaattttttaaagagaggaaaatatcaaatagttataaactctatgtgatggagactcagtggatagctactctagattaggaaaccagggaagaagcctagaagcaggagacaccgaagctaagatctaaaaaatcaagccaagcaaacttcaagggaaagggcataacagacagaggtaccagttggagcaaagagcctaaggcagaacaagttggctgagcgctcagggaagaactgaaaggtaggcaggtgctagacatacagagctttggaagcaaggcttgagttctggttttattctgagtggaatggaaagcaactggaagatttggggggttgggtgggagcagagttagggtgttgcaaatcaaaagttctacgttggccattttgagttatccatagagggacgagatgtgtagtgtgcatagcaatggtatttaaagtcatggaacagagcgaatccatctgggcagtatgcagataagggtcttggaacagcagctgcactaaatgaactcatctgagagacttaaatcattttgaagcaaataacactttatttagccccaggtaagtcaaaaacaaaaatttatagcttttagcaatttgctatcaaagtaggataatatacaagtagtgatgttcccaaattggtgttaggaagggggaatgtgagaataatcatagcgcattaatgtctttggaagaaaattcctatcacaatgaagaggatttgaatgaataggaaaacacttacatttgaaaagaaatcacttaagtgtttcttttgatctgacgatgagtttgaattctatgttagcgctatgaaacaatcagatttattatgtctgtatacagcttacaggtttacatgtgtgacacaacccataatgtataaaatcaataatgatcacttttgtattctctcctccaacatcaaaccttttcctgttccaggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcggcatttaacttacatttgtactttatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagtaaaagtaaaagtgctggagttgatccttcttgaaaaaaaaaatctctagattgggttttttatgttaggcatatagtacaagaaataaattgaccacctattgtaaagcgaggcatttgctaagagattttgtgtgcattttttagagaataaataggcgggtagtggctcacacccgtaatccctcttgacactttgggaggccaaggcagggggatcatttgagcccaggaattcaagttcagcatgggcaacaaagcaagaccccatttctaaaaaaaaataaaataattagccaggtgtggtggcacccatgtgtagtgccagctactcaagaagccaaggcaggaggatcccatgagcccaggagtttgaggctacagtgagctatgaacgtgccactgaactccagtctgggtgacagagcaagaccctgttttgaaaaacaagtcgatattgatccaattgctgaatactggaaaggcaaagtcagataaaactggattctcggaattaggaaaccaatgaccatcttagccaatgcaaatgtagcagagtagtgaagccagaatccagatggaagtgagtttaaaagtgaaagggaaggccaggtgtggcatctcgtgcctgtaatcccagcactttgggaatccgaggtgggtggatcacctgaggtcaggagtttgagaccagcctggccaaatggtgaaaccccatctctactaaaaatacaaaaaaaaaaaaaaaaaaaaaaaaaaattagcccggtgtggtggtgcatgcttgtaatcccagctacttgggaagctgaggcgggagactctcttgaacccaggaggcagaggctgcagtgagctgagatcgtaccattgcattccagcctgggtgacagagcaagactctgtctcaaaaaaaaaaaaaaaaaaaaaaaaaaaattgaaagggaaattaggagatgaggaacatgagatttcgagaagtatgatggagacagaaaggaaaggggctgggccatagccagaggggaaagaagggttgaaaaagggtttttttctaaaggggagagaaagaggttcacaagtttagaagctgagatgaaaaaaacaaaaacaaaaacaaaaataatggacagagagaagttgatgatgcagtggggagagggaatcattaatggaagatcttggagaagataaaatgagaggggcagtcctaagcagaaagaggaactggtttgggtgggctggagaagcatgccttcctctctgagaccacaagagaagaactgcagataagcatttgaagatgtttgtctatatgtaatggcacctgttttcttgtgtactagaaggcaaggtctgctgagaaagatgggtagcagatggggtcttttaaaaagttttttaattttttagagacagggtctgtctcagttgcccaggctggaatgcagtggtgcaactctagctcactgcagtctcgacctccaacattaacttttttttttccctagagacaggtgatttcaatgttacctaggctgctctcaaactcctgggctcaagtgatcctcccacttcagcctcccaagtgttgggattacaggtgtgagccaccatacccagcctgggatcttagcttgaaaagagtaataaatttgaaagactcaatgagagaaataggagaggacagtgactaaggtaaaatcaaatacaaggattgcagaagaggcatagaaggcccagatgaaattaaaagccatattgtttatagtgacagccatcgggagaactgattgatttcctccacctgtcctcagttaacttcagtaaagttgaggaaaaagagagcacgggccaggcgaggtggctcatgcctgtaatcccagcactttgggaggccaaggcgggcagatcacttgaggtcaggagttcaagaccagcctggccaacatggtgaaaccccacctctactaaaaatagaaaaaacttagccaggtgtggtgatacacgcctgtaatcctagctactcgggaggctgaggcaggagaattgcttgaacctataaagtggaggttgaggtgagctgagatagcgcgactgcactccagcctgggggacagagtgagactccgtctaaaaaaaaaaaaaagcatgaagaagaaagcggagaccacagattccgagttggccaggtgagcacaccaggggaacaaggggacagaggatgtggtatttcggctgggtggagaagggagaaataaaaggctgagaaaaatgcaggcaagggactgaagtctggcatgagccaaaagaggatgtaagttggagacagagtgaaggaaaattaagggtatgaggtgtaactggagagtaaatgggagagcgaaatataacagtacccacatacaggcaataagtagtctatttcatcagattagcatcaaaaatgaggcagtgtgcaccagagttaacaataaaataatataattttctttagtacaaatgacttaaaatgacagtgttaaaatgggttttgccttaattagattgattcattaggatgtcaattctattgtaaatataaaaatatttgaaaagtagcttaacacaaaaccacattgataaaatatactttggtgcctgaggtgggggtggaagagataactttcacaattacatgattgcttagaactgttcattttacttctgtagttaggagggcaaaagggtccagaatcaagatgtgtcaatattccaatatagagtatctttggaaggatttgctctggtctggagtttggtatataataaactcagtattggcagcctgagaagaaaaatggaagtaaataagttaagcaagaccttaatactttggcaaaggggcagaacctggaataggtgggagagtccagcagaggagctgggctctggttcatttgttggcattctctgtgagcccacgggggaatcacatcccttctttgggtcactcaatttccttactagtaccacttctaacactctatgactctccttatagaccccttgggtcaaatttccttggtgtaaccactctggattatcagaagtgtggaaagggttagaaagagttggaaagggtcagattttatttttttaaaaatagactaatttttgagcagttttagatgtatacaaaaaatgtagcagaaggtacagagctcccatgtacctccttacacataccccagtttccccaattattaacatcttgcattagcaggtacatttgttacagtggatgagccaatattgacacattattaactaaagtccattgtccacactagggttcatcttcgttttgtgcattctatgggttttgacacatgtatagtgatacacatctaccattacagtatcctacagaataatttcatggctctaaaaatcctctgtgttccatctattcatcccctccttcttcccaccccaacccctggcaaccatttatctttttactgtctccatagttttgccttgtctaaaatgtcatatagttggaatcatatagtatgcagtcttttcagattggcttctttctcttagcaatacatatttaaagttcttccatgtctttttgtggcttgatagctcatttaattttggtactgagtaacatttcattgtttggatgtgccattgtttatccattcacttattgaaggacatcttgtttgcctctaggttctggcaattatgaataaagctgctatcaacattcatgtgcaggtttttgtgtgtatgtaagtttttaactcatttggataaataccaaggagttgtgattgctagatggtatggtaagagtacgtttagttttggaagaagcttccaaattgtcttccaaagtggctgtaccattttgcatttgcaccagcattgaatgagagttctttttgctccacatctttgccagcatgtggtcttgtcagtgtttttggattctggtatctaataggtatgtagtggtatttcatttttgttttcatatacaattcagcaatgacatatgatgttgagcatcttttcatctatttgccattatataacttctttgatgacgtgtgtattcagatcatctgaccattttttttaactgggtcatttgttttcacgttgttgagtttagacttgattttatagaactcttttgccaatgacatgaggcttaaacaagcacccttgcttgaccctggctagtgttgtccagaggccctcatgggtgaagtataattgcacagtttatgcatacattgtagcaaacatagcttaaagactcttcatccaggagctggtaacagagaaaagttgtctaagagacatagtccactgaaaggggtctttgaaaaggaggattctggccagtagatccaaagaagaaggctggcaaacgccaccttaaccaactgatccaagttaacatcagtgatgagacatcgacatcttgtccttctcgagcacgtacatcacttctggggaactctttcccaaaaaagcgcaacctgaatccaattagaaggaaatgtcagacaaaatgaaactgagggacattctacaaaacgactggccagtactttttaaatgtggtttgatcgtgaaagaaaaagaatgacagagaaccgtcctagattaaagggagactaaggagacacgacatgcaatgtatgatcctggattgaatcttggaacagaaaaggacccttagaggggcaattaatgaaatgtggtaagtgctgtagattagctaatcgcattatcccagtgcgagtgccctgtgtttgatcactgcactggcgttatatacaatgtcaatatttagagaagctggctgaagggttacggaaatctcttgtgctgtttttgcaacattttcgaaagtcctaaattatttcaattcaaatgaaaagtttaaaaaacaaaaattagaagttccagaaggccgcgcgccagccgctcctgcgggacgggacacccgggttctcctggtgggagcccccagtgccgttcacgttccgcccgggggggggattaaactcgcacgcgagaagcaccgcccccgctcccgccccgccccgctcctctccggccgcgcagccgctgccgcccacccgcacccgccgtcatgctccgggccgcgctgcccgcgctcctgctgccgttgctgggcctcgccgctgctgccgtcgcgggtaagcccttacgtagtccctcgccgggaccgtgcgcgaccgccttcgcccccttcccaacgcacgctcttcgtccccgcgcacccgagggcggcccgcagacgcaacacccggccggccatcccgcccttccctgcacgcccgtcccccgtgggtcctggctccgggtcacctctcacccgcctgccctcggggaggggaggtggccgagaataagggagggctctgtcttcctcggagtccacatcctcaccgcagaccccactccgcggggagggaacccccaaattaggccagttggccggagaactgagggacttggagtcgcacgacgggcgccgtttcagggcaatttcgggctgaaatgagaagcggggacgttggtggcgatttcccctgctggtgcgcggccggagtggggttgctgggatgggggtgggggccggaggaagtaggccctcttttgcaagcagcgctgtttgtctagttggttggtgttcaagttgtttaaacaggaaaacagttcagccaaataacccctggatggaagaggaacgggaataggcaaagcttggatttcactgaaatcaaggagttttaaagttctagtctgctgttgtgcaagtgacatctgaaaaatcacacacgtgatcattcatttacaaaacgactcgtgaggaaaatgcacaattctattgaccgtggtctttatttttaaaaaatttccatacaagcatgtcaaaaatatgtggatggggagactctggagaacacagacttccaaaaacaccactgactgaataattccaggaattaaagagcaaaataaacaagaactaaatgagtacttgtgtgggcttaaataaagtgcaagagatttaaataaaatgcaagagattccccccccccaccccttgccccagatttcactgcgtttttataataactgcctgctcgaagtctactgacaggaatatttcagtggacctcagtgttggaggcagcagcagctcagaacttggatacaaacccaaggttcctttcttgaaaacttctgtggacctgcatttatgactggttgtgacatctgctgcctatcaaaggggcagaaacaagatgtgcccatgttcacattgttcagactgggaacattaattttgtctaagacaaagctgggctgtctctgaaccctccttctgcacaccctcattttgcgagccagtaacatctcaactctcatgtaaaccaccctctgcgaggctgtgcatttgtactttaggctagtcgaattttcttgtcagatttttctttcttgtcagacttttaaagaaaatcagtttctagattttggtatgtctcttcttcagtgaagctgttttgaccagcaatagagggcaaatttccctttggaaatttttgtgcatttcctttgataagtccagtgtggatcaataggcttttcaagagctttagaaaagtgcatgatgaataaattaatgttaattaatcagctcctcccagtcaggaagctttaaggattaatttggaaatgagtgtgagctttgacctagctagttaaccaacttatctgcacttcagtaaaacagagataatacttactcatggggctattgggagcattaagtgggaactccacgtctagtccctattacaggcgtggttcatcttggtttccttccctttattctcttcatacaaaatgaagggtaattgttgcaaccagaaaacgtatgaataccaccttatgtatattggatgtttatggttactgaacacattcatatgtatgctaatgttatagggctgaaaaactaagtgtgtttttcataatactttacaaatctcccatccaagcaagatcaggggtcatatttggcttagaactaagtcaagaaagagtttgttgctgaataccaagatcttaatagaaaagctcttatgatgttgcataataaatatgggtattgcatataaatgtgatgttgaaacggaaatcattgttattgtctgtcattctggaggttattagtgaagtgatcttaaccttgttcttagctattattttgaaaatcacagtggacaaaacattctttaaattcctgagtgaaaatccatggcatcgctttaaaaagtttttccgtaagggtgcttaagcacataatagatgatcagtatgtatttatttggtcagtggtttcctatgcctggcatgagctgagtgaacaagcatgttccgagtaagtcctcattctgtgatcatcatgtggatcagaatctagggattttgaattgccatgtcctacaagccttagatgaggtgcctctgccttcttccctgatgtcatctcttaccacccttcctgccattcactctgtgtatccacagagtaaacagtatctgggtactccaacacctctggtccttctgtgcacaccaccttcccccagtccttggcatggctgcccccacctccaccattcagatctctgttcatatgtcaccttctccgaagcctccctgaacacccacattctctgtcacatgtccatgttttatcttttccaagcctttctgaatgcattgtgtttattcatctgtcttgcttgttgcttctcttaccaggggaaagaagctccataacagagattttaccatcttgtggatttttgttttgttttgatttgtgtctctgcactttattctaagttataataaaaggatgaaaaaatttaggtgagttatttaaaaagtaggtaggataagtggattgcaatttttttcaaattatattacctctgctatgcactcatttcataatgaattcaaagccttaaatcatcttaatctattgctgccaccttttctttctttctttttttttttttccgagatggagtctcactctgtcacccaggctggagtgcggtggcgcaatctcggctcacagcaacctctaccttctgggttcaagcaattctcctgcctcagcctcccgagtagctgggattacaggcatgcgccaccatgcctggctaacttttgtatttttagtagagatggggtttcaccatgttggccaggctggtctcaaactcctggcctcgtgatctgcccacctcggcctcccaaagtgctgggattacaggtgtgagccaccgtgcccggcctgatgccaccttttctgactcttgtgtatggcacagttatgtttcaggggaaattatctcagattaaatattagagtattttaaaataaattttgagctgggcgtggtggctcacgcctgtaatcccagcactttgggaggccgaggcgggtggatcacgaggtcaggagatcgagaccatcctggctaacacggtgaaaccctgtctctactaaaaatacaaaaaattagccgggcgtggtggcaggcacctgtggtcccagctactcaggaggctgaggcaggagaatggcgtgaacccaggagacagagcttgcagtgagctgagatcgcgccactgcactccagcctgggcgacagagcgagactcagtctcaaaataaataaatgaataaataaataaataaataaataaataaattaattaattttgaaatgttaatgtttatttttcttccaatgaaaaagtgaaatttcaattaggtattatttcaggacttcttttactgttgagaatcttttaacaatttgcttatgtgttgaaaactagttttgcagcaaggttactttccataatttttattgtgcatatcaagtatttcattccttctgtgggttatttagtgtttttttttttattattttattttattttattttattttattttattgttttgagacagggcctcactctgtcacccaggctagagtgcagtggtgcaatcatggctcactacagccttgacctgctgggctcaagtgatcctcccacctcagccccctgagtagctgggactacaggtgcatgccaccatgccctgctaattttttttttttttttttgtagaggtggggtctcactttgttgcccaggctagtcccaaactcctgagctcaagtgatcctcctacctcagccttccaaagctctgggattacaggtgtgaactgccacgcctggcctattttagattttgagagcaaatcttgagaccaaatctttaaaaaatagaccagtgatgcccaaagagaaaggtacagattaacaatggcacaccccttctatgaatatacattataacagcccttctgaagagggaagtgatgggacaatatggagatggatgtcttgaaagctagattgggaagagtgatatggagaggggatgaggtgtcagagtgcctcaatttatttgggattcagagagatcttgaagctcagagtacagccacagaatctctggattagtcagggacttggaacagccactccctcctccatacattataaatgtaataaatagcccctcttcttcatctgtctgtgccacagttgcccttgcggaagttatgtgactacaactcatatcttaatgggagaggagcaaaggtcttattattgacaatgaaaatgaaaaagaagtctttcccttttcctttgttaacatttagaacaagtatgtcccaagaatcacttcctcatgctgtgcctgttttttttttctttttttaaaaaaaagagagacagagaacttataaaggaacagagagttctattagatttgactggtaatgcaaagtattcctgtggatatgacattatcttcttttagcacatgataattttaggcagaggatctatatagaaacttttggagttatgctaagtacagcttttaaaatattcatgaggctcctgaatttctgtacgtattaaagaattataaaattataaaatccctaagagtcatttaagtgcattattaataacaacctatcattcaggactgctgtgaagaaataagagtaataggccctttgcagagagcttagtgggcaggtttttaattatattaggattatggcaaagatacttagcgttgaagacgacttagtttagtcttttgttcatgaggtgcatgaacgtcaacaatctcctcacaggagttatccagcctctatttgagcactgttcttctcaaagtaaaaatatatcttttgagtagtgcttaaaacttgtttctggggcacacactctgatcggggatctatagcatgagaaaaggggttccatgttgaattaactggagttactgctaatgctgaaatgagcctaaggagaaggcagttgaaagttttggggaagtgagtcaacagtctgttttctatttttctatacataccctgttaaaaaaaaatttttttttggtcttgtcacatgcagatgctcctcgacttagaatggggctatatcccaataaacttgtgaagtcaaaaaatcgtaagttgtccattattaagttcgggaccatttctgtattgctaacttagttattcagcaatggtctttgagtagctggttatcattatcatcatcatagtcattcccatactgtgcaacacagtagcattgtgtttgctcctccctctgtttgcctgaaatatccatgtgacttctttccctatcttttcagacacacacacacacacacacacacacacacacacacacacacacagagttggttctctgtttctctggagaaccctgactaatacaataaccaataagatagtatggaaataagacagtgtgacaatcaaggctggattgtatgaagcattgcatatccacctttgccctcctttgaatcactcactctgggggaagctacctgccatgtcataaggaccctcaagcacccctgtgtagaagtccacgtggtgaggaactgtggtgtcctgcccacagccagcaccagctcaccacccatatgagtgaggcttcttgaagctgacctttcagctccagttcagtgtttagatggctgcagccctagccagcatcttcactgtaacttcatggagaccccaagccagaatcacccagacaagcaactgcttcagaattcctgacccagagaaactgtatataataagtgtttcttgttttaagctgctaattttttacatagcaatagaccacaatacaccatctaacatattattttatgtatttgtcttccttttgcataactgcgtcaactagaacataaatttccaggagggcaggaatttcttttcctttttgttcactgtggaatctcaagcaccttgcacaattttttaacagcaccccctcagataggtactgttattcccattatacagatgaggaaactgggacacagtaaggttaaataacatgtccacgattgtgtagtcagagccagacttttctccacagtctaatgggcttaaccagagtcctgtattgacccacttctatgcatcccttccagtgttatgttcaagacagaaggatagttattattgagagtagttagatctcagacatggtctctgctgtcgtggcgttaacaatcatttgggaaaacaggatgcatatcagatagccgctatataaagaaggatctaatgagtgctatgtaaacatgtataggccatcagagggtaacacatttccttttccaaagaagaatgactacccatagttcttatgatttgtgccatattatttttaaaaccctagacacaactaattggaataaggataatttccttagtcaaaagctggctactctaggctaggcatcagcccaatatggggcctagtatatgaacgctaagcctatttgactgttgagatagtatcctcagttttcttattggccatgtatctgtacaataaatctatcatctggtagcctgagcatgtctttagtccttgttgccagaaaaggtctctcatgcataatgcagtttaaaagtcctacagatgttcaaaggagtcacaggttagaggaagataaggctgagacacttcatggagaattgacacatgagctgccactgaaataagaatataccttaatcagtgttttagagatcatatcttcagatcgttttaatttataaagtataagaactacatgttttcacagcatgccaggagcaaaagatgaaaaaaagaactataagtgcttgacttgagtgttgattatatttttgtggacttattagacattttattttatataaatggtgtttcaaaaattaattcatttttatatattgtcgagttatttgttataagtagaaaacactatctgtagttttgactagaaataatacaaaagtgcatttctgaacctgtggttcaataattgccaatgatttataaaagtgtttcaggtgtcattcagtgtggtaatgcagttccatttcacttttttaaaattccataaggtaaaagaaaaagagcaataaaaggaaccagaagaaagtaaaaagggaaaaaagaagagaaagaataatcaaaatttgcaatttagagcctctgcccttttgactttcagtttgagttttattctggaaatgacttctgtgtcctctgtcatgtctctggcagcagagaggggaaggagggaagaaacctgcctttttatcctagttcactcattcaatgaatatttatggagaccttactaggtacctgtaactgtgctttttatcatatgccctctgcctggattttttttttctttttccttttatccgtggcaacttcctatttatccagtgagctgtagcttaaatattgcctactttttgaaatgctcacttattctacaaagttatactctccttctcctacatctcatagcattttacctatcctaccttcggaatatctgtttgtctgtccgactcttccatcagactgaccacttcaagtgtagaagacttttactctttttctcatcaccccttaacactaagcattatacctaacacataggagttgctcagcaaatgtctgatatggatgatgggtagatgggtgaccaactgttgacaacttgttgaaaagtataaaagatggaattttgcatctggctatcatggagtaggagactaacactcccattaagaacaactagaaaatctagattaaattccataagaatcgtatttgctggcatcagagagctgctaaggcagtttgctgaggtgagcccaacagtctgtgtattacttttctccttaggagagctggtaaaatcttaaatagctaaaagcagagcagagtttttggcaatctcatagtgttgaggaaagaaaaaacatgagtcttagctcaccaaagaggaggtggctctagttaatatccaggctttcaactggcaatccctacggatcaaaagtctacaaagtctagaacacctcttcacatagactcagtccctgctgatcagaatcctttctaaaggaagataacatcatttagagttactacaatttttcatacacagtgtttggcatttgatagaaaactaccagacagaacaaaaaaaaaaaacaggcctaagggggtgtgagggtgcagggtaggagagtagagaacagactaataactgacctagaaattagagttttcagaaatggacttcaaaataactacgataagttaaagaatataaatactaagattgagaattttaaaatataatcaaattgaaattttaaaaatataatcaagttgaaattctataactgaaaaatcactgacattataaactcaatagatggggtttaacagcatgaaaaactgaagtaggctgggcacagtgactcacgcctgtaatcccagcactttgggaggccaaggtaggaggattgcttgagaccaagagttcaagaccagcctgggcaatatagtgacacccctgtctctacaaaaaaaaaaatcaaacaaattagccatcctgtctactcaggaggctgaggtgggaggatcacctgagcccaggagttcaaggctgcaatgagctatgaccatgccattgtaccccagcctgggtgacagagagagatcttgtcttaaaaaaaaaaaaattggagttacccttaccccagttaagttacaacttaagagtgcattaataaaccaggaagaatgagattatattatggagagtattaacagtattgaaaagagcaaaaggatatacaggacatggtaaaaagtctaacatagatgtaattttggtcccagaaagggaagagagagagaatggagcaaaagtagcatctgaaatgataatggccaagaacttttcaaaagtgaccaatgaaaataagccacagattcagaaagtgcattgaattcttagcaggatttaaaaacactaaaacaacagcatgccactgtaaaactgctaaaaaccgaagacaaagaaaatcttgaaagcagcaagaagggggaaaagcacattactgtccaaaaagcaacagtgagactgacagttaacttctcagtagaaatgatggaagcccaagcaacaaaactatagtgattcattgcttaattaacaacagggatacattttgagaaatgcaatttttcattaggcaattttgtcattgtgcaaacatcgtagagtgtacttacacaaacctagatggtatgcctactacacacctaggccacgtgctggagcctattgctctgcagtaacttgcggaacctgtatggcatgttgctatactgaatactgtaggcaattgtagcacaacataagtatttgtgtttctaaacatagcaaaagcacagtaaaaataatggtattataacctcatgggaaccctgccatatatagtctatcattgaccaagatgtcattatatggtgcatgactatgtacatcttaaatgaaagataagctgccattctacaattctgtatttgcaaagatagccatcaaacatgaagacagtataaagaccttttttctttttctttttttttttttgagacggagtctcactctgttgtcaggctggagtgcagtggtgcaatcttggctcactgcaacctccgcctcctgggttcaagtgattctcctgcctcaggctccccaatagctgggattacaggcacccgccaccacacccagctaattttttgtattttttagtagagacaggttttcaccatgttggccaggctggtctcaaattcctgacctcaggtgatccacccacctcggtgctgggattacaggcgtgagccactgtgcctggtggagacatttatagagtatcaagaactgagggagtttccagtagacctgcacttaaagaaacaccaaagagatttctttaggcaaatggaaaattatcccagtcagtaatacagaaatgcgagaaggaatgaagagcaacagagagggtaaatatgtatttaaatctaaaagaacaccggccaggcaaaacagtaataaaacaataagataaaggaaaggaagccaatgaaattaaaatattgtatgtttctaggactgcctaggaagtggtaaaagtactgatttatttgaggtattaataaatcaaggtcacatattataattttcagggtagctactacagaaaaaaaattaaagaatatataattaacaagctaaaagaaaaaggatcaaatataaaatgtttaatacaaaaaagacaataaatgagaaaaaaggaacataaaataagtaggacaaatgaaaaacaaatattaagatggtagatataaactccaattcatcgtaactacattaagtattactggaaatacttcaattaaaagacaaaggtgatcaagctggatttaaaaaaaaactacttgctgcttgcaagaattataactacttagaaaaagtgtttggcagtatctgtgaaagctgggcacatgcatactcgatggccccagcaatctacttctacaaaggtactcacaagaagtatgcatagaatgtttaaagcagcattacaatggccacaaactagaaactacccaaatattcatcaacagaagaatgaataagttcttagataagtcttaaataaaatgatttttaaagtaacatttatcaaaagaagccagacacaaaagagtacacaatgtatgattccataactataaagttcaaaaacaggcaaaactaatcgatggtgttagaagttaggttagagatgacctttggaagggatggtgagcaaaaggggttaatgttctgttcctcattcctctgataattatatgggtatgtttactttataaaaaattcaccaaaaaataaaagaaaaaagaaaaaaattcaccaacctgtatatttatgacttgtgcattgcatgtatgttttatttgaataaaaagtttagtttttaaaaagtgtatcaggaaaggtattagaattggcagcaaggtcaattcagttatattttagtatgtaagaaacttggccgggcgcagtggctcatgcctgtaatcccagcactttgggaggccaaggtggcccaatcaccagaggtcaggagttcaagaccagcctaaccaacatggtgaaaccctgtctctactaaaaatacaaaaattagctgggtgtggtggcgggagcctgtaatcccagctattggggaggctgaggcaggagaatcacttgaacccaggaggcagaggttgcattgagctgagatcgcgccactgccctccagcctgggcgacagagtgagactctgtctcaaaaaaaaaaaaaaaaaaagaaaaagacaacatgcttcaagaaggaaaggttgaacccacagggaaagggagtgtttgaagatgctgaagagatgataaattaagctacttaaggacaaataagaggattcattcattcagctgaatattttaagtccctattataatccaagagctatctgaggtgttaggaatccaaaaattaataaggcttagtccctatttttagagtggtcactgtccaggagcaaaagatgccaatgatgatgtctgtaaaaactacatatttttaatactttccttgtacgagacactgtgctgtgcaggtttgcagtatcttacctgatatttacaacaatccaatgaggtagatgttatctcccttttcctgatgaaacacaggaaataatataagttttccaaggtctcaccaccaagataaaaacataagtctgtctgacgttaaagccgtgttcctgctggtactttacactgccattggatggtgtgtggttacatgcaacagtcacaatcaattctagtggggatgtcttggagaaggtggtatagatggcctgagcctcaaaggatgagcagacagagaataatgtttgatggcctggaagtggatttgaaggaagaagagtcttttctctgaataaaggccagattttcaaagaaggtggcagaaatgtataatgaacctgagacgactgagtgctgtttctcagggaaaggatctacctgctccatatacagactttcaaccaagtgtcttgttttcagaccttcctcctacaaagctgtctggcgtctccaattcctgactctgttctggacttctttgctttgtaaatgttggtatcatgtaattttatagccagattgttttaatgtttcataatgaacattttcccaaagcaaactgcttgttgcaaaacaaccgtatctttaagccagcattgtgggagagttctagattcctgccagagttaaacccaaggtagtcatatgtgtaattcaagtgctcataaaacagctggaaggaaaaaaaatttggatataaaataaattataggtggggcacagtggctctcacttgtaatcccagcacttcggaagcccaaggtgggagaattgctgagcccaggagttccagagcagcctgggcaacatagcaagaccttgtctctacaaaaaaattaaaaaattagccgggtgtagtgttgtgtacctgtaatcccagctactcaggaggcggaggcacaagaatcacttgagcctgggaggcggaggttgcagtgagccaaggtcatgccactgcactctagcctgggtgacagagtaagactctgtctcaaaaaaaaaaaaaaaaaaaagtctgtacggatacagggagcacactgcttccttttaaaggcaagaccgctatgttgaacattccacttctgctaaaccctaattatccagaagttataagactgcgaagcaatctagcttggtggccatgtgctctgtgctatataagaagctgaggtcagtactggggacaaccaatgctctctgccatattctgagcttagtaaacttgagagtgttgaattaatttagattaatgtagctgattggtaaattctgatctttgtggtagggcttgcttctacttgtttatattaaaaaggtaatgcagaacttaggcctggcgtggtggctcacacctgttattccagcagtttaagagaccaaggcgggtggatcgcttgtgcttaggagtttgagaccagcctgggcaacgtggcgaaaccttgtctctacaaaaaatacaaaagttagccgggcatggtggcacatacctgcagtcccagctacacggaacgctgaggtgggaggatcccttgagcccaggaggcagaggctgcagtgagctgagatcgcgccactgcactccagccaggacgacagtacaagatcttgtctcaaaaaaaaaaaaaaaaaaaaaaaaaaagcagaacttaaaacataaaattgctacatatttatatagatgaaatcactaagatttttacctatatacaaacctaacagaatatggacgcttactgctttgtacttctttattcactggaattaagtaaaattctctttccattttggccagtgaaatcaactcttgcagggttacttttgcttttaatactaaccaattaaattctagagcctaggcttaaaaatgcaaatctttataataaaaagagactaagatagaggtgaaggagatgtccctttagagcagtagaggaagagttatggttctatttcattgaactacctcaaataatctactttgatgaggtgttaaattaagaacattcataagaacatcaatcttgttttcctgtgcaatatgaaaacttgtgtgaatatttataggctagcaacttgtttttcttttctctgttcttggaggtataatttgaacaacagggccttgtaaaagtcttaagacttttgaaattgttaaatactgcaaagataaccttcaaagagaagtgtgtaatcctgattggctgtcttctagatagtttgttgccttggtgataacactaatttacatgtctgaattcctaaacaacctaaaaacttgtatctttgctctgtaaagtcagaagagaatcattggcacatttctcttttcccgtatgaataatggagagaaacaaattcctgttacactggttgatttcttattttaataaagatttaacaaaggaaattgcctttgtgtgtgtgtgaaaatttagtatctaatatccttatctttgggaattcatgtaattctttttctcaagttatttaacagtgttcttcttttttctacatagactgtccttcatctacttggattcagttccaagacagttgttacatttttctccaagaagccatcaaagtagaaagcatagaggatgtcagaaatcagtgtactgaccatggtaaaaggcttattcttttctgtttgttttttcacaaattagtgaacagtgttcattaatttctttaaaaattgattttgtcacatctgacttttaactgggtcctgagatttaatgtacaacttttatttgacaacacacaagctacaggcagtggaattgggtatatatttaatcctggagttggaagacagttgttggacaatattgtccaaagcagggtctatttaacatgcatatcctgtgccaggcactgtgcttaagcacctcatatactttacctggctttatcataacaaacctatcaagtagtgtattattatcattttattgagagatgaaattaacttcagttatttgttcaagcttacacaggaaataattgacaaagccaggattttaacccagatctgttggattttaggcttagagttcttaatcacttagttattctgcctggaaagtgctgaagtcagattacataggaccatgaagtaagactgtagtaaagaagagtacattaaggaaaaattataaaaaggctatttgctagaccatacactcagtgttctctaggaaatagatttataacatcacattgtaaaatatttgaagtgtctttttttttttttttgagacagggtcttgctgtgtcccccaggcttgagtgcagtggcatgatcatagctcactacagccttgaactcctgggttcaagtgatcctcccatgtcagccccctgaatagacaggactacaggcgtgcgctagctattttatctgtttgtttgtagagacagggtttcactatgttgcccaggctggtctgaaactcttggcctcaagtgatcctctcaccttggccttccaaggtgctgggattacaggtgtgagccactgcatccagccaaaaaaatgtctttttttttttttttttttttttttgtgagatggagtctcgctctgtcgcctaggctggagtgcagtggcgtgatctcggctcactgcaagctgcgcctcccgggttcacgccattctcctgcctcagcctcccgagtagctgggattaccagcgcccaccaataggcccggctaattttttgtgtttttagtagagacggggtttcactgttggccaggatggtctcgtctcctgaccttgtgatcaggatcaagtgattctcctgcctcagcctcccgagtagctgagattacaggggtgcatcaccacacctggctaattttttgtatttttagtagaaacaaggtttcaccacgttaaccaggctggtgccgaactcctgaggtcaggcaatccacctgcctcagcctcccaaagtgctgggattacaggtgtgagccaccatgcccagcctaaaggtgctttttattactgttatattcttcaacaataacatttggaagaatgtatcaaattgtactagggataccttaatcaaaatcatatacatttattatagaaggaataaatgtaaacaccaaagttattaatcttattaaagcgccacatagtacttaatacatatatgttgtttccctttgaaaaagtcttacatgaacattggctctgtgaaaacaagacgaaatttccaacatgccaatatggttttatttcaaggcagttgaaataaaataatagcaattttgctggtcttagaatatttttaaaacaagttttcccctgcaactattttctttcctttcttcctttttcttcttcctcttttctttctttctctctcttttcatttgttctttctttctttcccttttttttttttaatggagtctcagtctgttgcccaggctggagtgcagtggtgtgatctcagctcattgcaacctctacctcctgggttcaagcaattctcctgcctcagcctcctgagtagctgggattacaggtgggtgccaccagacccaactaattttattttattttatttttttttggtagggacaggatttcgtcatgttggccaggctggtctcaaactcctgacctcaggtgatccacccgcctcagcctcccaaagtgctgggattacaggcatgagccaccacgcccagcccctacaactattttccatcccttaaaaaaaattatgtaaagtatactgagacataaacataatttcaatgacataaatcatattagaggctgagagccaagacatgtccctgtaaccttattagcttgtatgaactgtaagatcaaagtttattgtccagctctaatatatatagaaagttaagcaactatttattatttttatgtacctagtgattttcactgattctggaatatgctgactttttttctctttaaaataatttcaggagcggacatgataagcatacataatgaagaagaaaatgcttttatactggatactttgaaaaagcaatggaaaggcccagatgatatcctactaggcatgttttatgacacagatggtaagtgatatttacctcgtgggacgtgactttgttgttctttttttaatgtagcaaaactgatggcttttcaattctctggttcaagttgatgattcctgtggcctccaggtgttaaattttcagtgtgcacctatgatcataccacagcttgtatctgcatagctcaatgagttacacagatgaaagccacagttgattcttgtctggattaaaatgtggctctaaggctcagtatttttgtaatatagcatgatcataaaggtaagtattagtgtctgcaactaataggctaaggatagactaaattatcacggttctattatataaacatatttatcattactgtagacaaagtacatatgtacaaatataaaagtacatatgtaaacattttcaaatgaaatgaaattactaaggttactattaatatttaactatttttcttgacttttttcccatgagaatattatacatgtatatatttttgcgaaaattggatcatcttcagaaacctcttaaatcgatagcttttgatgatttggctgtacacaggatatattcctccttctaattttaatcctacaatcagaagtttagaccagacataccttagtaactttccacctttaatcctacaccctttttggcttgaactccttttaaaactgtcataatgttgaaaatattccttaattgacagatgcgagtttcaagtggtttgataattcaaatatgacatttgataagtggacagaccaagatgatgatgaggatttagttgacacctgtgcttttctgcacatcaagacaggtgaatggaaaaaaggaaattgtgaagtttcttctgtggaaggaacactatgcaaaacagctagtaagtatgaccgaaggtgtttttccattctagaaggggcagagaaagtaggactggttttaaaataattttgagataagtgtgcctcaataaatagaataaggctaggcacagtggctcacgcctgcaatcccagcattatggtaaactgaggcactggattgcttgagcgcaggagttgaagaccagcttgagcaacatggcgaaaactcatctctacaaaaaatacaaaaatcagctgggcatggtggcgtgcacctgcggtccgaaatacatgggagcctgaggtgggaggatcaattgagcctgggaggttgaggctgcagtaagcctgggcaacagagcaacactctgtctcaaaaagaaaaaaaaaaatagagggaataagacttcagaatatattaataggatggtttgctcttaagtctcttggaactcaaattgtaattctcttacatttaggaggtaaggccagatcacatgaaataggcatacttttattctgtctgcttagtgtttccaagaggtcaaaaatttcttgttcagaggaattattataatctctttgcatgtgatttgagtgagcagaagtggtgaagagtaatcatgtataattccagaattctcgtgttactttacaaggaattagattctccataagaacatcctttgtttaggcaaacaaaaactacatcatagtttataatttatttggaattaaaatgttttcttctgacccgtcagaaggttttttttttttttttttttttttttgcgatgcagtctctctctgtcgcccaggctggagtgcggtggcgcgatcttggctcactgcaacctctgcctcctggcttcaagcgattctcctgcctcagcctcccaagtagctgggactacaggcacccgccaccatgcccggctaatttttgtattttttagtagagatggggtttcaccatattggccaggctggtctcgaactcctgaccttgtgatctgcccacctcagcctcccaaagtgttaggattacagacgtgagccactgtgcccggcccagaaggttttttaatgaacagaagttatcctggcccacaacagtattttgatgttatttgttaaaacactacacagtttgttattctaagttttagaaagtaactgttttctcattaaagaaaattaaattttcaaaatgtgggctgggtacagtggctcatgcttgtaatcccagcactttttgaggctgaggcagcctgggtcaacatagcaagaccaccatctctacaaaaaaagtttttagtttttttaatgtttcaaaatatgaatttagggtgcttaaaacatgatataaacaaccatttccccattttgcatcctcagtattttccccttctacttcaactgtaaaccaaaactccacatcctgctttatttcctttctttacatatggaagtatgtacatttctttacttgctacagcaggatccttgactactgttagttttacagtgattatcaaaatgttcgtcatagttttatggtagcagtattcaacttcaaatatttgttttttaaaaaattggttcttttcaggttctgcacctcagggtgccattacataaacaaagtttttaattaaactataacttcaaaacatcagaaatagtgagtacatccatactaaggtagttagggtcacagttgtttaattttatgacatttgttttctagactctccaaccagaatcctcttttttcctttacctcattattgtcttttcctcaagatcccgtattcttttccaccaaccaagctaatgcatgttgttagccctctacatctttctttaaaaactaagttcaaaatagacaacagagacaactaatgaggcaaagaaatatggattttaggctatgaatatattgatattaagctactaataaaagggtttatttttaatgattgtgaacatgtttaaagtcaatcctataataaagcataattaaattctaatttttattttcttttgtattttagtcccatacaaaaggaaatatttatcaggtaagtaatgatttggtctttaaatttttcccacaattaaaaatatatcaaaattctggcatattaaaatacattacagatccctttttaaaattatgtaatataaagtagaacaatttttataagaatgtagaaaggtctcttagtaataagactcaacattttaaatatattctacaatatgtagttttgtctggcttcttttactcgggaatatttttttagattcatctgtgttgtgcacattcactgaattttttccctaagtgtcataatactttataaatatatcatatattgtccattctcttgtttatggatatttggatcacttctagttttaaactaatttgaatagaactgcctatgaacattctcccacatcttcttttggacctatgttctcattttctttgagtatattctagaaagtagaaagctgggtcatagggcaagtatatatatttagatttattagaaaccaccaaataatttttcaaaatgcttgaatcatgttactactggcagtgcgtccaagttccatttgctccatgttcatcccatgatggtattgtcaatttatttttagccattcagatcaggtgtgtagtgatcttcttgtggctttaattttcatttacctgataatgatgttgagcacctttcagatgattatttatttgtatatcttttgtgaaaaggcttttacccatttgcggagtgcagtggtgtgagcttgactcaccgcagtcttgacctcctgggctcaagcgatacttccacctcagcctcccaagtagctgggactacaggtgtgggccgccatgcccagctaactttttttgtacagatggagtttcaccatgttacccaggctagtctcaaactcctgggttcaaaggatccacccgcctcagcctcccaaagtgctgagattacaggcgttgggccgccatgcccagccacccatattttttttgagttgcctatatttttggtaggaatttttaaaacaaattttgtttctttaaatttggatatgggccgggctaaataatacaaaacttagccgggcacggtggcgggcgcctgtaatcccggctacttgggaggttgaggcagggagaattgcatgaatttgggaggcggaggttgcagtgagccgagatcacgccactgccctccagcctcggcgacagagtgactccatctcacaaaaaaaaaaaaaaaaaaaaaaaaattggatgtgagtcctttgccagttttctatttgggggttactacgatagaactatgacagaggaggagaaaagaagtgttgggtttgtgtgtatacaggaattacatcctcattaatctataggaagaagacaataaataacaagcattagtgtggatatgcagcaattggaactcttgtggtaggaatgtaaaatggtgcagcctctgtgaaaaacagtgtggtggttcttcaaaaaaaattattaaaagaattaccgtatgatccagcaattctgagtatgtatcccaaataactgaaagcaaggactctttaatatccgtacacccatctgtttgatatttgtgtatctatgttcatagcatcatttgccatagccaaaaggtggaagcaacccaagtgtccactgatgaagggataaacaaaatgtaatctgcacatacaactgagtatcatttagccttaaaagagaagaaaattctgacacgtgctacaacatgcataaacctgaaggacattaggctaaacaaaataagccaggcacaggccgggcgcagtggctcacgcctgtaatcccagcactttgggaggctgagaccggtggatcacctgaggtcaggagtttgagaccagcctggccaacatggcgaaatcccgactctactttaaaaaaaaaaaaaaaaaagttgaaacccggaggcagaggctgcagtgagccgggatcactccactgcactccagcctgggcgagacagagcaagcctccatctaaaacaaaacaaaacaaaaccaccacaaaaaaaaaagaaaaataagccagtcataaaaggccaaattctgtataattcttacctatagtatgaggtacctaaagtagtcaacctcaccaagaaactctttgccaagggttaggtcaggaagaaatgggagtttaataggtacagtttccattttacaaaatgagttgttctgtgaatggatggtggtgatgtagcacaacgaagtgaatgtacttaatgctactgcacacctaagatggtatttgttacatgtatttctttaaattacatttttaaaaaatcaagcagcggaagcatgttatttagacatggagacagataaatagctgaagcaacagtagtagttaactttaaggaatggatgttcaggtgagtagtggagcaggagcacagtattttcactacgtatcttctagaactatgacttttaagctacgtaaatgtattactttggaaaaaataaagatacacataagttggaacatttagaaaaaaataggtctgtggcttcaaaaacgaatagttgaaagatctggcaacatatggtcttcagactacaagaaaagtaatctctgaattcattacatgtatgcatgtatatatgtgcatgtaaatctgtattaaatatgtgtatgtaatttagtgagtaaacactatgtgtcaggctttctcctaaagttagacattgaagacagagcaatgaacaaaacaaaagcctctgctctcaagcatacattctagtgggaagggtaaaacaaaactatgtgagatggtgacacatcctatagggaaaacaggcagataaggatgaattccagtgcaagaagggaggtgttgcactttatttttatttttagtacagtggccagggaaggcctcatttaataaggccatgattttgcataatgaagacctaaagtcaaagtgaaagcctgtcatgtagatagggattaggcttagtctgactttaaggagtaaaacagtagagaacatggagttgaagcagcaaggaaacaacccaacagttaagtgtagctgccatcttggcaaacagggagttccccttcataccaagggtaagctggaagactcccttgggaagaatactttcaacagaattaaggtgtccatagtcggatgcacctagtgtggcaagcacacaggaaaggtcaagttagtccaagctgggttcagcaaaggttactggagaggatgcaggagttaaatcttcaaggataagtagacatcaggcaggagacagaggacaggttatctgaggtgacaaatcaggaccaaggtgaagggttgaatttttgctgtcacttactaaatggacttgggcaagtcatttaaaccctgtgcctcagaattaaatgcacagttggcactctcacctgaggctacagcctaacaaaatgtttcatatagtttttgaggtggattatgtatagttcgggcctcagatgatcagtgttagaactagagcgttaaggtagcagtcagatagataaataggaaacagaagaaaaatgtgtagtcttcacaatttatagagaggaagtctataaatttccagattggttgactggacagtggctatttatttgcaggaattcaggttagaagaaatttggaagtagggctacacacacatatttatctatggatttacataaaagacttgaatggttgagatcaaccatggaaagctttgagtccacaaagatgactaggaagcagtcgtctgaaaaatagagcagtcagggaagccaagtgagtaggagataacttcaaggctggacggctaacaatctagttgccccaggatgaactaaaacatccacgtgtttaagcatgtagtcataaagagatcattggtgacctctgccacagaaatttctgaagaaatgttgagaaaatggattaaatgggcttaagaaatgaaaaagtgagcttgtttcagtgtttgctgtttcctcaagtaaggaacattgttaggctaaaaagtatttttcctaaattttgtttctttaaaaaaaacaggatttcatggtaaatagctattatatgctgtcaagcaagcaatggacctttcctttaattaatgaggtagataatacatttcctaatgtaaaactatcctaacctccagatataaactacacattgttttaatacactgcttatcagttgccttgacaattgactttgtcacacattttagtagtatgcagctagctaactaaaacccctggaggcaactttggctaaaggtcacttgcagaatgtgaaaagcagcatatatacttactgtgtctcgcccatcttggacactgtccagttcttaggatacccggtcttttaaagctattatgattgagtctgtaaatatttctcaattactatgatctttcagacttttctatattactatcatgtaattcctatttaaagtagatgctaccgattatgaagccattattgtacaatcattagtacactgaaataaagtgtgttcacactggtaaagttgaggttctacactgaaaatggactatgttaattctaataaaactaactacggggctgggcacggtggcccacacctgtaatcccagcactctgggaggccgaggggggcagatcacttgaagccaggggtttcggaccaacctgggcaacatggcaaaactgtctctactaaaaatacaaaaattagctggacatcatggcgtgcgcctgtcatctcagctacccaggctgacacatgagaatccctggcacccagaaggcggaggttgccgtagccaaaaactatggaagaaccccatttgaactcagtttacggaattcttggctttttttcattttaatgtctttaataataccaccaccaaatccaccctcacaccttaccaaatctttactaccaaattttatttcagaattaaaaagatagttcacttggggccatttcctcactcctcccaaaaaatcctgtcaatatttgaaaagtatcaatggctctccctcactttaacaaataatttggccaaatttctctcactaatcttaaattcttccaggtctcattttaacaagcaccagttgaaataatgggtattatgaatatatttaataataaaaaatctgtcaaaataattctgaaaagttttcacattctttagagtcgattactatacataatacaagtacctgcccaaaagtatgtttgttctcctaaaccaggttattttcctcaatttattaaactggattcttatagaaagattacaagggtttgaataggcaagaactgcaaagttgtgcatacttacagaaatttagggaaacacacaaagaatgaatgaatgcaaagacacacaaaaccaggtactttactgcaggtcttggtgtttttttcagttaaacaaatcttaaatccccaaagccaggtgaaccattaaacctcaataatgtaacacattatctaaatactagaattcctaaagggaacagtaggtctgaatttgtagtcttagatcagaaagtaaagcgaaggaagacaaactggagcatggtatatacttgcgtgatttccactatggggtcttcagtagagtggagaagtgcacaacttcctagaaaatttgagtactattcttcaggctaagaaatataaatcttgttagtaacaaatgcgaaatttttggttttctcatcagtgtgggaaattctcaacacagagaaatgtttacacaaaactacagttgtgctcatcaaaatatacttgcaacttgtgtaccctaatttcccaaatactcttttgtcttttccttttcagataaccacattttaatatcagcattggtgattgctagcacggtaattttgacagttttgggagcaatcatttggttcctgtacaaaaaacattctgattctcgtttcaccacagttttttcaaccgcaccccaatcaccttataatgaagactgtgttttggtagttggagaagaaaatgaatatcctgttcaatttgactaa

SEQ ID NO: 4 - DNA, 4416 bp, Homo sapiens
aggagacagaaagctagggagggagaggaggagaaggaggtggggcccggctcctcgtcccctcttcctccgcccaccacgcctcccctccccccggacgtgtaaatgagactctgcaaactggaaagcagcgaaaggacacctccttccttttctctcttgttgtttttaagtggaatgagagagagaggagtggagagggaaaagaagagagagagggagaagagagagaggagagaaagagcgagagagcgagagagagagacagagacagagagagagagagagagagagagagagagaaagagagagagagagagagagaataagctggggtaaagtattttcgcagtttctgcctttaggattttattagcttctctcccccaggccgcagccaatcagcgcgcgtgcccgggcccctgcgtctcttgcgtcaagacggccgtgctgagcgaatgcaggcgacttgcgagctgggagcgatttaaaacgctttggattcccccggcctgggtggggagagcgagctgggtgccccctagattccccgcccccgcacctcatgagccgaccctcggctccatggagcccggcaattatgccaccttggatggagccaaggatatcgaaggcttgctgggagcgggaggggggcggaatctggtcgcccactcccctctgaccagccacccagcggcgcctacgctgatgcctgctgtcaactatgcccccttggatctgccaggctcggcggagccgccaaagcaatgccacccatgccctggggtgccccaggggacgtccccagctcccgtgccttatggttactttggaggcgggtactactcctgccgagtgtcccggagctcgctgaaaccctgtgcccaggcagccaccctggccgcgtaccccgcggagactcccacggccggggaagagtaccccagccgccccactgagtttgccttctatccgggatatccgggaacctaccagcctatggccagttacctggacgtgtctgtggtgcagactctgggtgctcctggagaaccgcgacatgactccctgttgcctgtggacagttaccagtcttgggctctcgctggtggctggaacagccagatgtgttgccagggagaacagaacccaccaggtcccttttggaaggcagcatttgcaggtacctctattaccctgggtccccttgtctctgagcctggggttgtgggtcccaatggcatttccctgggaggaggaggagggagacttggagctggtgaggatgagcttggtgctcctcccttggttattaggactctgaaggaggtctgagtagctggagggcctggatggaggtcagtgtgaggggcctgagctgggtgctatctgaagcctgaaggccacctcacttctccaggaggccctgggaccagcctttcaacatgtctgagaggtttagatctctttgctgttgagtggggatcagggtgtccctacccagcacaattccaaactaattctacacaaaagctaaataactctcaattcggtgcgtggggagtgggtgtgggagatgggtaaaaaggtattggatgtactgtagagaatacaacctctcactttctattagatgagttttccaatttccaaagaaaaatttaggtttcctgcagccgtgacatatgtgtgtgcactgggatgggttaatgtgtgtgtgtgtgtgtgtatgcgcatgtattgggagtgggggcagaaacgtgtttccagaatttgcctgtagaatctaaaagagtggccaagagtctggaaatgcatgaagactggacgtatgtgatggtgggcaaaggcctgactgtgtgtggtgtgtgggtatgtttgcagattcgcgggtgtgagagcagtgatgggtgagggtggccttcaggagccaaggctgagcggtggtgagagaacaagccggaagccagggtgctgtcctggtatgctttggaggaacaggattgcacgtgcgcctgtagggtgacctgtgtgcacctgtgagatgacttagcttggggcttgcaaggcctgggtctgcatgggtgggtatctgaccatgccttttcctccctccctttcacgccgcgcagactccagcgggcagcaccctcctgacgcctgcgcctttcgtcgcggccgcaagaaacgcattccgtacagcaaggggcagttgcgggagctggagcgggagtatgcggctaacaagttcatcaccaaggacaagaggcgcaagatctcggcagccaccagcctctcggagcgccagattaccatctggtttcagaaccgccgggtcaaagagaagaaggttctcgccaaggtgaagaacagcgctaccccttaagagatctccttgcctgggtgggaggagcgaaagtgggggtgtcctggggagaccaggaacctgccaagcccaggctggggccaaggactctgctgagaggcccctagagacaacacccttcccaggccactggctgctggactgttcctcaggagcggcctgggtacccagtatgtgcagggagacggaaccccatgtgacagcccactccaccagggttcccaaagaacctggcccagtcataatcattcatcctgacagtggcaataatcacgataaccagtactagctgccatgatcgttagcctcatattttctatctagagctctgtagagcactttagaaaccgctttcatgaattgagctaattatgaataaatttggaaggcgatccctttgcagggaagctttctctcagacccccttccattacacctctcaccctggtaacagcaggaagactgaggagaggggaacgggcagattcgttgtgtggctgtgatgtccgtttagcatttttctcagctgacagctgggtaggtggacaattgtagaggctgtctcttcctccctccttgtccaccccatagggtgtacccactggtcttggaagcacccatccttaatacgatgatttttctgtcgtgtgaaaatgaagccagcaggctgcccctagtcagtccttccttccagagaaaaagagatttgagaaagtgcctgggtaattcaccattaatttcctcccccaaactctctgagtcttcccttaatatttctggtggttctgaccaaagcaggtcatggtttgttgagcatttgggatcccagtgaagtagatgtttgtagccttgcatacttagcccttcccaggcacaaacggagtggcagagtggtgccaaccctgttttcccagtccacgtagacagattcacagtgcggaattctggaagctggagacagacgggctctttgcagagccgggactctgagagggacatgagggcctctgcctctgtgttcattctctgatgtcctgtacctgggctcagtgcccggtgggactcatctcctggccgcgcagcaaagccagcgggttcgtgctggtccttcctgcaccttaggctgggggtggggggcctgccggcgcattctccacgattgagcgcacaggcctgaagtctggacaacccgcagaaccgaagctccgagcagcgggtcggtggcgagtagtggggtcggtggcgagcagttggtggtgggccgcggccgccactacctcgaggacatttccctcccggagccagctctcctagaaaccccgcggcggccgccgcagccaagtgtttatggcccgcggtcgggtgggatcctagccctgtctcctctcctgggaaggagtgagggtgggacgtgacttagacacctacaaatctatttaccaaagaggagcccgggactgagggaaaaggccaaagagtgtgagtgcatgcggactgggggttcaggggaagaggacgaggaggaggaagatgaggtcgatttcctgatttaaaaaatcgtccaagccccgtggtccagcttaaggtcctcggttacatgcgccgctcagagcaggtcactttctgccttccacgtcctccttcaaggaagccccatgtgggtagctttcaatatcgcaggttcttactcctctgcctctataagctcaaacccaccaacgatcgggcaagtaaaccccctccctcgccgacttcggaactggcgagagttcagcgcagatgggcctgtggggagggggcaagatagatgagggggagcggcatggtgcggggtgaccccttggagagaggaaaaaggccacaagaggggctgccaccgccactaacggagatggccctggtagagacctttgggggtctggaacctctggactccccatgctctaactcccacactctgctatcagaaacttaaacttgaggattttctctgtttttcactcgcaataaattcagagcaaacaaaa

SEQ ID NO: 5 - DNA, 12115 bp, Homo sapiens
gagggtgcgcccaccggtcccgccgggcgcccgcgggacgcgccgccagggccctctccgccgggggctcggcgctcgcccacctcttccaaatttaaccattacctaaatccgaagggaaatgagcaaacctctcggattgggtgtcaaggtattttcagcctcgttgggcgtatttatccccaagtgtttccacaacaagctatttcggggcctgcggggcaggtttcgctctgcggacgccgtggccactcgccgggctccaggccggcggcaccgcgggccggtgattcacggtcccgacccgggggtggtgcagccctaggaggcggcggggtcgggggtggggggggcgggtgaccgaggcctgaggggcggggagggtcctcggagcggggcgccccccacccctctctcgccagtcaatctgtgtcctcaatctgtggcttctctcgctgcggaagtctccctggagccaagaatagttcattttctttcaagtcatttctagtgcctaagtgtccggacctccaatttcccccatcccctgccgacccacagggagagaactgggaggactactaaggggcgcgcgggacgggctggaaaggccaggccccccaccgcctggccacttgcgcaaaggagcgcgcccggccgcccgacgggggttgggagcaggtctgggagggctatgcgagcgactcagtaacgctcaggaagtgaagcttgtggttttgggggctgagctcggaaggagaattttttttttttttaagtcagagagatagagcggtctctcccgaaagcaagattccgtttgaaaactctcctagcgcggtgcccgcgccgtgactccgcaggtaggtccgccgagcctgttctgcgcctcctgccctggtgggggcggccgcggggactcgcagagcactggcactgcgggggcgatcagagggcgcgggcggtttcccacctgctgcggaccgccgtgcgggagcccagagagctccggcagctgggttagggcgcgacccgcgcagtgtgactggaaatctggagctgggggcgcgcagcaggcggtctggtggttcggcaggggagccaaatccaccagggaaggaaacatctggtggggaggcggcggcagctgcgctcgggaggacgcccccttagcgccctcggctccctccttcctgggcccggacggtgaggagaggcctgagcgcgcggaggggccgccccacctcccgcgccagctgcagcgcggggttgccttcccacgcgctcggcccaggccccggggcccctatctcctccaaactctgtcgctccccacaggaaccagcaaagcgggccggggtgcgagagaggcgtgggcttacagcccgggtggggaggcggcctccgcgtccgcctggtctctggtggcgccagcccagacccagctccggcgctgacagttaccccgcccccatctgtcccgctcccagccaacgtgggtccaagctgcagcgggaccctcgggacaacgccactccgtttttcttttcttccgagtttcgtggctgtttaaagaattgggtttggggtttgtggcgtctaattgtacggacgagaagtgcaggaagcgacaaagctctagccctaggagccaccccggagggaggcggatggcactctcacccctaggggcattctggcgcttgggtagcgggaaacttcgcgggagccccgcgacacgtcccaggcgtcttttctcccaggtctattcccattcctccggagaaggggacacaatggggctggggatctggagcagggggcctgcaccctacagggaccaaggcctgtaggactcgtttgagctgagagcgccaacggacagacgtagactgtgtggcctgcatcttgcctaggaagccgaggggctcctagtccggcagtggaaacagcgcgaagccggaggactgcaggtcctgccccggcccagagttcccagcaccctcgtttctgaaccagccgaggccacggagaactgctgtactgcagctcacgtgtgaacccggtcaccatcgccttcaccccgggaggaaggcagattcgtttactccagaccacctcgactgtggggtaccgcccccggagccggctggagcctagcggcaggcgcagccacgccctcccgctgcgctcagatttcgacctggtattaggtgaactgattgggggttaatgagagcgacgccccgggcagctagttccctcccgggcccgggcccgacccccgctctctgctaatgcagcctgcgcgctctggcgtcctgtcttttttgtctgctaaattgtcggtgcactaccgactcgggacacctagcatttcccagtcaacgttcgtggatcgggctccacctccctaggacaagattttttggtgagcagaacggaaagtgcttttttcccgggacctgattcccgaggttaggtctccatggtctgggatggctcgccgcagcctcgaccggtgcccgccgcagccgggagtccaagggcaaagtttctcctacgtggggcactagtgaggggcgagtgggatcacccagatgcgagtttctcctggggcgggggttggtcgtctgttgttcccctcactttcctgtccctttgctctcccacctcctttctctggcctctgctgtccccaatccctctgctgctgtcctcccgccgccccacagttttatcttgtgttctgttcccccctccccccggtcctttcactccagttggtagctggctcttggaggtcttggctccttgccccttccgggtcctcgaccactgggcatccccggcccctaaaccgatccgcgtgtccccgccctccctcgccagccgtaaagcacagccaggcaggcgatgagtagctgagttggggtaacccacccgatgggaactacagctctccagggagtttgattgccggagcgagcttcgctaggaaaggggaggagctggggggcgtgggcagggaggaggaaaggggcctgagacagggccccgggacaggttttaccgctgagctgtgtcagtggcggcggcggcaacgacggcgggttcgcgccacctgtccaagtgccacctggtaagcgcggcgcagcagggtcaagcccctcctcccgtgggccctctgcgcgcctccctggcccgcgctctccctccgcctgggtgcccagtccgccgcaccggagagtactgacccacgtctccacctggttttctttccctctcaggtctcctccgggctggggctgagcaagccctcggagtgaccgtgggtgacagcggctccagggactcttggggcgcagtggggaaagtgccggaccaccatgccgcgctcatttctcgtcaaaagcaagaaggctcacagctaccaccagccgcgctccccaggaccagactattccctccgtttagagaatgtaccggcgcctagccgagcaggtgcgaggcgcgcgcgggccaggcggggctgctcccccggatgcctactgcacctcggcacaccattagtccggagctgggaggggctgccccaacgtcccttttgctgctgtttttgtttcctactgtcctggttcctccgggtttgtctcctaggtgccatggcctctctgcgcctgccctcggatccgagagggttcccggccggggtctgggtggagaggggaagacgctcggctgccctggtcgggggattgggggagccttcagcaccctcagactcaaccggtcccagcctgagcccctcacctgcctcctctttgcagacagcacttcaaatgcaggcggggcgaaggcggagccccgggaccgtttgtcccccgaatcgcagctgaccgaagccccagacagagcctccgcatccccagacagctgcgaaggcagcgtctgcgaacggagctcggagtttgaggacttctggaggcccccgtcaccctccgcgtctccaggtaggaacccactgggaacctcttgggcgggagctgcagggacccggcagtgctgggggggaattggcgcgaccttgggcgtagaaatgctaacggggagttggagagtctttccgggagaagggagctgattcgtaggggaaggaggcatccggcttctctgggacttggacagcttgcccgctggggctgctgcctccatcccaggcggcaggaccctagctgcttgtcgcttagattcgtttgcgcggagctggccagtgacggaaaacaaaccagtcgtttcgactggcggcaacgctgacctttcattttctgaccagacctgactgttttataaagtgctaggatcctgcaatctagacccccaaacctcaaacagagaacagggcagaacgggccaggcagaggagctaggcgctgggcggcagggagggggcaggacgaaaatctcagcccgcggcttggtcttcacaggcgcagattgggggcctgtttcatttttcgttttgccgggttaacctagcctcaggggcctgctctctgggtttcatttccagcgagcaatccagcttcaggcaaactaagtgaccacacgttgggtgggggcgtctcgagtcccggccgggggaaggaatgagcagaccagccggattctgtcaagggccggttatatccagaatatgtttgctagttttagaagataccaccacccgtcccacaatcagtgagttgacttggcgaaaaccatagctccagcaagtgtgtctgggagccggcggcgggaggattcttcctgccagggcgtcaagtggccagacaaggattgggcgcgccccgaacccctccgaacgaaactccgggtacagcctctcactgaagtggccagcctgaactggagtgttgtgcgcacacacacacacacacatttgtaaatgccgtatgcactcacatgcgttggggtcactagttttagcaaaattcacgtgggtgggggcgtagcaggccgagaattcagagctgtctccttgcaggtggtggctaaaccttatgagttatagttattctctgagaaattcaggttccccgcctccatcaaactgtaacaggaatggggagtatttggctgtcaatttaagcccaaaagcccctttcctgctgctcctttgctacgtacactgggcacttaacttcgtgaaatcttaataccttcgggtttattcagacagcagcctttcgggtagttcggggccgcatttatggaccttctccctccttcctcttggattctgggaagaaaaagaattgaatgggaacatgtaggggctgggagagtgcctgcgctggtggctggacccttccgcccttgagtgctgtgaggggccgaacggccgccaccttctccttcttaacagctcaactacgggcatttatagatgcgcccttccctgtaggatctccaggtgcgcgggtccagccagaaaagatcctcggaacgccgagcgcctccgctgcactcgcacagaatttacgacctcctctcccgaggtcttttcaatgatctgtttactgttctgcctcctatagtggcctgcgaggccccagggcccgggccacgttttaccctggggcgagcctggcacctggcgcacgcagtgttctacaagcgctgggtgccccgcagtccgcgaacacgccacgctcgcagccgcagcccggcggcctccgctctgccgtctgaagcctgaccggacgctccccttgtgcctccacagcctcggagaagtcaatgtgcccatcgctggacgaagcccagcccttccccctgcctttcaaaccgtactcatggagcggcctggcgggttctgacctgcggcacctggtgcagagctaccgaccgtgtggggccctggagcgtggcgctggcctgggcctcttctgcgaacccgccccggagcctggccacccggccgcgctgtacggcccgaagcgggctgccggcggcgcgggggccggggcgccagggagctgcagcgcaggggccggtgccaccgctggccctggcctagggctctacggcgacttcgggtctgcggcagccgggctgtatgagaggcccacggcagcggcgggcttgctgtaccccgagcgtggccacgggctgcacgcagacaagggcgctggcgtcaaggtggagtcggagctgctgtgcacccgcctgctgctgggcggcggctcctacaagtgcatcaagtgcagcaaggtgaggctcccgagctcaccacctcgcctgccgtgcgcccgcttcccctacccgcgcctcgcctgcgccccgcggcccctctcagcggccttctctctggccccacccgccttaggtgttctccacgccgcacgggctcgaggtgcacgtgcgcaggtcccacagcggtaccagaccctttgcctgcgagatgtgcggcaagaccttcgggcacgcggtgagcctggagcagcacaaagccgtgcactcgcaggtaagcgcggggcgcaccgccgcgcgcggccctgctcggggatcttctgcatctcctcggtgcagcaccagccactctctgcctggaagttttctcctcgacttcccccagtttcctcccccaagccctccgctgcgtccccttgccctggtgcaggtgtgtagggaaaggaggattgtggccggctcaggccttgaggcagccctggattttggtgtcacaccactgtgagcctcgagagtgtgatcctcattgttactttgggcttgaggtaggtttgtatgcactgattcgtgctgctgatatatcagacttactagctctgtttctttgtgcctattcttttcaccaaatggttgtcacttaatttgcattgacccctctcgactgaaaaggcaggaatctcagctcatttagagcatctagtagcatattcaccccgctattcattctttccttccttcctttcttttcttttcttttttcttttcttttctttcagagtctggctctgttgcccaggctggagggcagttgcacaatctcagctcactgcaacctccccctgtcaggttaaagtgattctcgtgcctcagcctcctaagtagctgggattacaggcgcatgccactacagcacagctaatttttgtgttcttagtagagacgggatttcgccacgttagccaggctggtcacgaactcctggcctcaagtgatccaccagcctgggcctcccaaagtgctgggattacaggcgtgagccaccatgccccaccgccgctatttattcattcattcattaataaatatttgttggctaacttccaggtgccaagtacttaagaatcttataacacatcaggtccttgacagcatgcccacatgaagattatagtttagctgagagatggagagtagatgagcaagtaaatatgccaatagctatctcaggagaatgcctacttacgaaggctaaaaagagtattagcccatctcccccagcacccacactggctggggggaggtggcatctcaagtgactgaggtctaagcctcctgttgaggagggtggagaagtgtgtgctaatgggtgtcaaaaaaagcagggtgtggatatgtatttgccatggggtgtggaaggttgtgggtgaagaatgttttggtagaaaaagtgttgaagggccaggcacggtggctcacgcctgtaatcccaatactttgagaggccgaggtgggcgaatcacttgaggccaggtgtttgagaccagcctgaccaacatggtgaaaccccatctctactaaaaatacaaaaattagtcaggtgtgatggcgtgtgcctgtagtccctgctacttgggaggctgagacacgagaattgcttgaacctgggaggtggagggtgcagtgaactgagatcgttccactgcactcaagcctgggcgacagaggagactgtctcaaaaaaagaaagaaaaagtgttcaagggattttagggtcagctgaggggtgaggagagcagcagtctagttgactgcagtaggagttctgcatctctctctctctctctctctctctctctctctctctgcaggaacggagctttgactgtaagatctgtgggaagagcttcaagaggtcatccacactgtccacacacctgcttatccactcagacactcggccctacccctgtcagtactgtggcaagaggttccaccagaagtcagacatgaagaaacacactttcatccacactggtgagctaaaaaggcccttggcttgtaggaaacaccctgaggccaacattactcatcttctctgatttctggccccagtgagtggtggatgaggcctttctgatggagttattctctgctctgtgttaaagaaaacaaaggggtgggttctttggttcatttaccggcataattctccccagagccaccttgatttggggttgtgtctgaaaggccactcagcaggtcagctcacaggtactctatacttggaaagaacattttcctttaggttagcagctgcttcccctgctgcctgctctgggtgaaatatgaagctccagggtcctcttagagagttgctctaaagcttacctagagattgaggactttccctaaccacctggccttttgtgggagggactcgtgtggactctccggctgcattttcaggagtctgagagcttattctgattgaagaggaacaaataatggcaaatatgattaaactctctgctaagcattttttaaatgcattatttcattttatgctcacaacaactctgagaggtagcgactactccttctccccattttagagatgaaaaaaatgaggctaggtaatctgcccagggtcacactgctagcaaatgacagggccagagctcaaattcaggtctgacctctcaaatgttcactcttgaccactgtttattgtattttatgttcagagtcatgaggttggtagacagaaagcttctgttcacttattgcccttttcaaaatatctgcaagttaatgccataataatgataattccttacctattataatgctttataatttacaaagtactttcaaatctatcatttcatttgattcttattgccactcaagaaagtagaaggagctgctcttaccatcctgaaactcagaaagagtgaatgatttatcagaagtaagactgaatgaataatgtagccatgtaatgctctggcttttaatcctggactgtttgtctaacactttatgtgcgggtgggagttttaatgccaagaacactctaatagtcaaaagacatttacatgagacccagaatttctgaaaattttattgcagaatatgaatactgatttagaacaaatcacagtgtattctaaacacccacccttgatgtttataaatatacttgggtaatgtatatatttccattgaaaacccagaaaagtattctactttaatcattccctcttacctgaaatttccatgtaattcactccttataagtaaggtattcaggacacttatcaaaatgcaactaggatcttgactgaataaaacattaagcccttatcaaacatttacgttatacctagaatttgttttctcagatttgtttgaccctaaagggatagaatacattttgatgggtggtttcttatcaaggaaatctgaagcatgaaaacagaaaagagtttttagcaaggaggacagagggttcctcaaaaacaaacttcatctattttatactttttccaaggctgagccctgactataatgccatgctgggctattggaaattcatgccatttacccaacaacacatgagatggggaacaagacaaaaccttcttgtgttctcttatttattaatttgtggtgaagaattgctggtatataaagaatcatgtgattaaccccataaaattaaggaaaaatcaagacagtaaagtatcagctgccttaatcctttgtggcccaaatgtggatttttaaaataagatattgaaaaacgtatcctgcacatgtaccccggaacttagaaagaaagagagagagagagagaaataaagaaagaaagaaagtccatgttaagatgttttttcagatataatctgctgtccttcaagaacaagaaagaagacgggctcactgatccatacaaactaacacccacttggaaattcagatttgaaaacttcctctgaattagaacggagtcacacggttttaggacagcttccccctccccttcctgttgaacatctgctctgagtgttcatggcttataaagtcaggggagtcctcccggggtagattcagctggggagggcacgtggcctttgctctgtttccgtttagcaggaaaccgtttgaggcctttggctgggaaccccccttcagaaagtctccctttcacctggtgcccccatggtgcttccagggactcgcattgcaggctgggagtcagttcaggttgcaacacgtcaccctccaagttgcttgaaggccttagactgtggtgcaaccagctgctgccaagagcatgtgggtcacagtgggtcccctctagctttatcatagactcatactttctcccctccccctcccatccccacaggtgagaagcctcacaagtgccaggtgtgcggcaaggcattcagccagagctccaacctcatcacccacagccgcaaacacacaggcttcaagcccttcggctgcgacctctgtgggaagggtttccagaggaaggtggacctccgaaggcaccgggagacgcagcatgggctcaaatgagcaccctggctggctgcaagcagcagctacacaacactacagagggcagcctccctgcttgccaccactctgctccctgcttgcctccactcccttctgactttccagaccccaggtccagtctgcagatcctaccaggttgctcctccttcgccttacctcctggagctgccagaagaaatgaggtaccttttcaaagtgcagccgagagtgagaaccaagtgactctctaggcttcggacacaaataggctcctctacacctgaagacaaaggcaaagtcaaatggggaccagaataaatcttagaccccacagtccttcccatttccagccctaatctacagacaggaatgcccttcaggtttcttccctcccccctcttgacctaccccagatatttgtgtggaagaggaggaatcaccatttacaaggtggacaaatgctaatatttttatctagaaagaagagtgagtgttaacttttatttttttccttctggggggtctgttgactcctttcttttgggtgctgcctataaatcttggaggaatcatttctcctcctcaaaaactgattcagaaactgacttggggaaggaatttaatactttgaagtcatgagatgcaccatcgaggctacccccaagaagaagcagaagagaagttggtaatgagaggggattagaggtcctcccttcagtagggctgtgaaaacctcatcactggaggtaaaagcacaagcaatgcctgtggacaagatgtcattcattcactcagcaaatgttcatggatcaccggctaccaaggtaccaggcaccatgctaggtattggggaagagagactgaagtcacaacccctgactgctcctcaaaagctaacggttgcacctccaagtggctgggtctgttcttactcttggagggaattctgagaagacagcacagaattgtaaaccttcccttttgacccttttggattttatcaggtgtaaacaaaaagctgaacagttacttcaaagatatgtgtgtatattcagttttttattgttaagctgatattttaaagatttctgagctagcaggcatgtgggaaggaaggctctgtcttcaactctttgaccctccatgtgtaccatagaggggggaaaggtggtattttcactttgatgaggttggtaaatgtttttagatcttctggtaagcattatgtttgttaatacatatttattagagtgatgttttaagttaataaagtattaagagtatt

SEQ ID NO: 6 - DNA, 33146 bp, Homo sapiens
ggagttgagcccaatctctcttccccactgcaagaccctggtgcagtggttcctatacctattgcgatggtcctgaagaaagtcttccttgacatgctttaacatgtgttattgaataacattttaacagttatggtgctgcaactcagataggaccagattcatccctggacgtagcttctccctaggacattaagtgagtgcctttgaagtctttgtcttccttcctgactgactcatcaggaagtcagactcccgaaccattgctccaaatatccgttgaagcaggtaaggacagactttgattcctttgttgttgttgttttttcttggtttgagacagggtctcactctatcacccaggctggagtgcggtggtgcaatcatagctcactgcagcctcaaactccagggctcaagcaatcctcccacctcagcctcctgagtagctgggactacaggcacaccaccgtgcctggctaattttttattttttgttttttgtagagatggggtctcactatgttatccaggctgatcttgaactctttggctcacgtgatcctcccaccttgacctcccaaagtgctgggattataggcatgagccgctatgcctggcacagactttttttttttgagatggagtcttgctctgtcacccaggctggagtgcggtggtgtgatctcggctcactgcaacctctgcctcccaggttcaagtgattctcctgcctcagcctcccgagtagctgggactgcaggcatgcaccgccccgcccggctaatttttgtattttaagtagagacggggtttcaccatgttggccaggctggtctcgaactcctgaccttgtgatccacccgcctcggcctcccaaagtgctggaattacaggcatgagccaccgctggcacagactttgattcttaaagtatgggtatatttgctgaagctgggttagagtcccaggtttcttttgaaaggtactttctgggctggaagtccttcttcctggccctctgtgaggcctccctattctctctgttctctctattggatcctgcttctcccacgggaaacttttctgtcacctgaaagctctcttctcgaactcctgctgactctatcctctgccaactgtgtaccccactgccaggcccttttcctctccactccagcccctcagtctcttgtaccttagaccccctacccttcactgggggctcttaaggaactcagcacctcattccgcaagcaagcacctgaagctgaaaataaaataacaacaacaaaaatagaactgtttgaaaactgagactgggtgtggtggctcatgcctgtaatcccagcactttgggaggctgaggcaggagacttctttgagctgaggagttttagatgagtctgggcaacatagcaagaccccatgtctataacaaacttaaaatatagccaggtttgaaggcacacacctgtggttccagctacttgggaggctgaggttggaagattacttgagtctgggaggtcgaggctgcagtgagctgtgactgcaccactgcactccggccggcctcagtaacagactgagaccttgtctcaaaaataaaaaataaaaaaagcaaaacaaagaaaaagaaaactggacaaatgaaaaaatcttaaaagttgccttcacagatattggtaaaaatttttagtccttactgggttggtaaccttaatttgtcccatttgtatcagaaacataattggatgtgaagataaaccagtgaatttatattatcctggtttactgcctcatgattcaaatttttaagatgaaaagctataagatctgtttacatctgtctgtatgtttatgtatgtgtatatgtatgtatgtatgcatgtttgtttgttatgtatacatgatatttttctaacttcaatgctaatacaaaacgaaaatagcaaattgtcttagggataaatgcgcactcaaacaaattaagtattcataaaattatcagaaaaataaaaaactgaacaatttttttcaagttcacatgatccaggatagtctttagtaaataaaagttagttttaaaattgttggtaaaatgaaaataggactgtcttcagaactgttatcattaaatacagacatacagtttttcctgagtatgctggtaagatacgtttgtgttgtatttgctagatgtttaaggtcataaagctataaatctaacctaagaacagaatgtacaagaaaaatgaattgcttaattgctttgtgcatgtcaggacataaaagttaaaaaaaaaaaagaaccttgtttaactttttagtttcattgcttttgtgatgtttttgatacttacctgatttattaataggaaaaatactttaaaatagtgcctacctttgtttaatgtttcatgacatttttcatgagcaattaaaccgtaattgctgcgaataaataaattaggagaatgtagtagaataaaaatttgtaaatgaacttttaaaaaataattatgctttaaaagatgtctacttgaaaatagtttcaaaaatctttttgtgacaacttgcaaccttaaagttgtgttaagtaaaattgagtaattgatattcattaaaaatttagactcaactgtggaaaagaaatcttgtcatgtgtggtcaaagctggctaagattggctagatttatttgtgaagttttattaaaaattagttctactagtacattgatgcaaaagtagaatttggtcgtctttctaaaaattatgaagtttccttgaactattggtctgagaatgtgaagggttttttttttcctttaagtaattggcctagaaaataaaaattttatgtcttatcaagggaatttcttgttcttgatgttgtcttttatcacgtctttggttacttaagaaaactaaatcttctcaatatcaaaaaacctaagtttttcttcacaactatgtaatctgctatatttgcctttaaaatattttattgtcaccaacatggtgaaaccctgtttctactaaaaatacaaaaattagtctggcgtgatggtgcgtgcctgcaatcccagctacttgggaggctgaggcagcagaattgaacccaggaggcggaggttacagtgagctgagattgcaccactgtactctagcctgggcaacaagaatgaaactctgtctcaaaaaaaaaaagttatcaacactttgattagataaccgagattatgtttaattaagtgctttaacccttttgacattttttataaacttcccaaaatcatattctaaattaagtctttttaacttcaagttaattttggtattttccagttgagccccaggatatctcaaaaggtatgtctctcacctagtaaaagaaagatattaaaataattacacttatttcatatgttaaattatataggaagcattgtgaaatgagaaataatgtttaaccttgtttgagttaaatttgtatggacatgttattaatatatgctccagaaactataggaaattcctagaaatgtagtatgttatcagtcataattttgattattatgttaaaaggttgtatgccacagaaatcaaattttcttaattgtatcactattataatgaactctcatcagatctttaaccatgccattttacatctttatcatccatagacagttattttacttaaattattctgtaaaagcatttgcaagacttagctccagttcaaagttgcttctttgtcaaggaaattaataaaaagactgtgtcaattaccctggaatacaggtttctgataactttaagataataccattggacttggttagacattccagaactctagtgaaaatgatgggctcatgaaactgtgatctcacgatcaagcagaacaaatattaactacgtggattgtagtatcatatggcttcatgtattaactacatgaatataaactgatgaacataattttcacgttaaaaaaagttatttttgccgggtgccagtggctcggctcacatctgtaatcccagcattttgggaggctgaggcggacggatcaccagaggtcagaagttcgagaccagcctggccaacatggtgaaaccccgtccctactaaaaatacaaaaaaaaaattagccaggcgtggtggtgggcacctgtaatcccagctacttgggaagctgaggcagtagaatcacttgaacccgggaggcagaggttgcagtgagccaagatcgccccattgcactccagcctggacgacaaaagcaagactccgtctcaaaaaaagaaaattatttttattttctttatttttctttctaacacttctccctcaccacccatgagtttttatttgaaacattgctggtttttttgaatgttttattttccagattttctttttttgttgagacgcagtcttgttctgttgccaggctggagtgcagtggtgcaatctcggctcactgcaacctctgcgtcccgggttcaagcgattctcctgcctcagcctctcaagtagctgggactagacaagctccactgcgcacagccaatttttgtatttttagtagagacaaggtttcaccatgttggccaggatggtcttgatcttttgaccttgtgatctacgtgccttggcttcccaaagtgctgggattacaggcgtgagccactgtgtccggcctattttccacatttaaaaaagtttttttttttttttgcctgggtgcattggctcatgcctgtaatcccagcactttgggaggccgaggcgggtggatcacctgaagtcaggagtttgaaacgagcctggccaacatggtgagaccccatctctagtaaaaatacaaaattatctggatgtggtggtgtgcacctgtaatcccagctacttgggaggctgaggcatgagaattgcttgaacccgggaggcagaggttgcagtcagctgagatcgcaccattgcactccagcctgggcaacaagaatgaaactgtgtctcaaaaaaaaaataaaataaaaaataaataaataattaaaaagatgtgtttcccccccccttttaaactatctatagcttacagcaacttggcaaactttattagacaaaaatggaaacatttactttttctccctacctaattcctccagaattcagaagctattcatgagttttttttttttcttatctacctacaatctgaactagctcttgaattctgtttattttctccatcatctggccacaactcttcaaactaatatttccaattttctcccacccttctgttttggaatcactgaaattaaaactgctcttttcctgaagtcctgcaagctgaagctgacaacttgacataaacttcagagaagctgccacaacagtttatgtatggccagccttcatgatagccaaacagcaaaccagggaaatctgtcattttccactgcttgctgaagatggttcaggcccagcatctagaaatcttctggagcggctgccctttggatttagaaactgagtttacagtttgttcccactattaaccttgtttttcttttattttcatagaaactgaacttcccttattaaaaacctgctgacttacacttacactatctaggagagctccactaacaagtcccaacagatgattttgctggtccttaatgaaccagctaagattggctagatttatttatgaaatttgattaaaaattagttctggtaggccgggcgcagtggctcacgcctgtaatcccagtactttgggaggcagaggcgggcagatcacctgaggtcaggagtttgagatcagcctaggcaacactatgaaaccccgtctctactaaaaaagtacaaaattagccgggcgtggtggcacatgcctgtaatcccagatactcaggaggctgaggcaggagaatcacttgaacctgggaggcggaggatgtggaggatgcggtgagctgagatcatgccattgcactccagcctgggcaacaagagtaaatctctgtctcaccaaaaaaaaaaaaaaaaattagttctggtagtacattgatgcaaaagtagaatttgatcttctttgtaaaaatgacaaatttttcttgaactatttgagaatgtgaagtgtttttttttccttttaagtaattggcctagaaaataaagattttgtattttatcaagataatttattgtacttgatgactgaaccaaaaaccggacttatattgttcaaagggaagaagaatgtctctttcctttgaacaagaagggggactgacaaagattctttgcttggccaaactttagtaagatttctgaatcatctgcacacttccctgtaaaatctagtttaagcaaaaaccctgctaagtccgtttagtgaaaatcctcatccttgacatctgatcatcgtcagtatctgatcaggttcctcggcctccaccatgccccaggtgatattggatcaccctggcttgtcttcagcaagaacctggttaagtcaatttagccagaatcctcctaacccctgatgcttcctcttagcaattttccatctgctgacccccacccaatctacttcttaagtataaattcccacttgcccatgctgtgttcagagttgagcccaatttctcttccccggtgcaagaccccattgcagtaccccattaagtgttcctaatagtgattgcaataatcctaaataggccaagcatggtggctcacgcctgtaatcccagcactttgggaggccaaggcgggtggatcatctgaggttaggagtttgagaccagcccagccaacatggtgaaaccctgtctctactaaaaataaaaaaatcagccaggcatggtggtacgtgcctgtaatcccagctacttgggaggctgaggcataagaattgcttgaacccaggaggtggaggttgcagtgatccaagatcatgccattgcactccaacctgggccacagagcaagaccttgtctcaaaaaacaaacagacaaacacaaaaaacaaaccaaaaaacacaaccaaaaacaatagtcctaaataaagtcttccttactgtgctttaacaagtatcattgaggccgggtgtggtggctcacgcctataatcccagtactttgggaggcagaggcaggtgaaccacgaggtcaggagtttgagaccagcctgaccaacatggtgaaatcctgcctctacaaaattctgtaaaaaaattttacaaaatgtttttgtaaaaatacaaaaaaaattagcctgggcatggcggagtgtgcctgtaatcccagctactcaggaggctgaggcaggagaattgcttgaacctgggaggcggaggttgcagtgagtcgagattgtgccattgtatttcagcctggacgacaagagcaaaactccgtcaaacaaacaaacaaacaaaacccacaacaacaaaaaaactcaaatattattgaatatttttccttaacattagtttatttcatacatatatacattcatatagatatgtgttcatatataactatataaaatctatcctatagccagtctgtccaacacccacacttttttccttggcttaagttagacattgtcagttttggttgctttccatcaaaataatcatatctagtacctctgctatcttctatatggaggccttggtctgattggacagacgtggccatgcctttgggagacgcttctgaaggaggcaggccttgccccaggaagcctcagccagaaggggaaaaataagaagtcattgctgccgggtgcagtggctcatgcctgtaatcccagcactttgggaggccaaggcgggtggatcacctgaggtcaggagttcgagaccagcctggccaacatggtgaagccccgtctctactgaaaatacaaacattagccaggtgtggtggtgcatgcctgtagtcccagctattcgggaggctgaagcaggagaatcgcttgaatctgggtggcggaggctgcagggagctgagatcatgccactgcactccagcctgggtaagacagagcgagactgtctcaaagaaaagaagtcattgcatatataggaagctccaaacaggtttgaatcttgggtgctccggctgtgtatccaggtgctgggctgttctgacaactatggccatggattccagggacttcctggaagggtgattttccagttaacttttgttataccgacatctaggctgagacaccgatatttatgtgtgttctcagagacagagcctaaagtggggagacagtgttgggggcaggaggcagaagaaggaggggtgggggcagctggtgctcgtggacaggaaatttcctcttagagcctcctgcaagtgggaaaacacccacaccttaggtccctgtgaccatacagtgcctggccctggtgagttaaaactcaatttgaggtggggtgtggtggctcacacctgtaatttcagcactttgggaggcagaggcaggaggattgcttgaggccaggagttcaggaccagcctgggcaacatagcgagacccctgtctctctttttttttgagacggagttttggtcttgttgcccaggctggagtgtaatggtgtggtctcgggtccctgcaatctctgccttctggattcaagcgattctcctgcctctcagccttctaagtggctgggattacaggcatccgtcaccacacccagctaatcattgtatttttagtagagagagggtttcaccatgttgaccaggctggtctcgaactcctgacctcagttgatccacttgcctcagcctcccagagtgctgggattacagatgtgagccactgcacccggcctgtattttttttttgtttgtttttttttttgttttttttttttttgagacagagtctcgctctgtcgcctaggctggagtgcagtggcgcgatcttggctcactgcaagctccgcctcccgggttcacgccattctcctgcctcagcctcctgagtagctgggactacaggagcccgccatcacgcccggctcagtttttgtatttttagtagagatggggtttcactgtgttagccaggatggtctcgatctcctgaccttgtgatccacccgcctcggcctcccaaaatgctggaattacagccgtgagccacccggcctgttttttaaaaaagaaaaatacagtccagctgtgggggctcacgcctgtaatcctagcactttgggaggccaaggtgggaggattgcttgaggtcaggagttcaaaccaatctggccaacatagtgagaccctgtctccaaaaaagaaaaaaacaaaaaaaccaaaaaactacgtaactcaatttgtgtttttcttcccgtgcaaaaaacaaaaaaacaaaaagccacgtaactcaatttgtgtttttcttcctgtgcagtggggtcactggcgttcgcccctccccagttgccatttccctgtctctgttgcccctagtctccttaccttctctgtccagctccctgaagcccctaagcagcctcttttttttgagacagagtcttgctctgttgccccagctggagtgcagtggtgccttctcggctcactgcaacctccacctcccgggttcaagctattctcctgacttagccttacaggcacctaccaccactcccagctaatttttgtatttttagtagagacggggttttgctgtgttggccaggctggtctcgaactcctgacctcaggtgattcactcgccttggcctcccaaagtgctaggattacaggcgtgagccaccgtacccggccccctaagcagcctcttaaactggccatctgagaagcagaactcttgaggtgaggagtttggtttggggctcagagggccgcgcgtgtgtggcctctgtctgtccggggatggggtgggcgtgtttggctttcgaggtggattcgtgcttgtgtgagagggtgtgtgtttctcattcctggtatcctcagttccgggcgtggcgtgtccctccgtgtgagtgacggtgggaaggtgaggtgagagtggccagggcggggtggaactgttttctctcggcccgtccaggttggctgcttttgggtaattcccaggctctgagatgtcacagagccaggacgggaggagtgagtcacccccaccattccgccattgccctggagaagcttcttccctgtccccagggcccggtttcactgggagccataaaaaggccctgcccaagcttggtttcttccgttttcagccggacctgctgaaaccaagcctgggggctgcctgggagcgtgccaagggcactgcccagatggggcccagcccagagggaaaccagcccagcagggacccagctccagctaaggccagaaaccagagcccacccttgggggctgttctgttcctggtctcatctggtttatacatatatatatatacacatacatatatatatatatacacacacacatacacatacatatatatatatacacacatacacacatatatatatatatatatacacacacacatacatatatatatatatatatatattttttttttgacacagtgtcgagctctgtcgcccaggttggggtgcagtggcataatcttggcttagttcaacctctgcctcccaggttcaagtgattctcctgcctcagcctcctgagtagctgggactacaggcatgcaccaccatgccctggctaatttttgtatttttaacagagatgggttttcaccattttggccaggctggtctcgaactcctgacctcaagtgatccgcccaccttggcctcccaaagttctgggattacaggcattagccaccgcgcctggccacatctggtttatatcttaagcccctctgcccaccaggagccccttcccctgcaggactatgccccaggccccctccactcccagactcccctctgtaagctcccctttcttccctgagccccattcctctccaagagccccctcccctatctgaagctcctcttctcctggagacccttcccctcccagttcccccgcaccccctccctccactgcccctccctcttaaagtcccctacccttctgtcctgtcacttccctgccctctcgctccctggggtgggagggcctggcttggcgaggcggctaagagaggggaaggggctcagggtgggggcagggcatgtctggggtctgccagcttgtcttggcctggctggctctctattccattatgaacatgtggctggggtttctgccatcctcccaggccctggtggggtggttggggctgagagggtgatggggaggggaggaggaaggggccgcaatgccaatcacatcaccccaggggctcagaacagctcccgcctctcctcctcctccccttctttctcgcccccacccccctccccaccttccagagcccattagcccagggctgcagtgacacctgcctccactggggatcctcccctactcctggggccatagctgctcccccaagggtgggttaccctcttgccttttgaccttcccagggacctggcagtcctgcccctgggtggccacctcttcagcctctcccagagccttggccacacttgctgtgccgtccgcaaacacccaagggggcaccgtgcccagtccaggaatcaggcagccatcaccttcccagccagaccctgggaaggatagacccacagccttagccatatacagagcactgggcaacttttacttttcaccatgatgagcaacttgtcaaaagaatttgcaaacagacaggtgcggtggctcccgcctgggattataggaggctgaggcgaggggatcacctgagatcagaagttccagaccagcctggccaacatggtgaaaccccatctctactaaaaatacaaaaattagccaggtgtggtggcgtgtgcctgtaatcccagctactcgggaggctgaggcaggagaatcacttgcacccaggaggcagaggctgcagtgaactgagagcttgccactgcactccagcctggatgacagagcaagactccgtctcattaaaaaaaagaagaagaatttccaaatcctacctctggctcaccattaaaacagccaatttgggggtgtttggggcagccggttacaattctccctctctacccctccacctgccactagcacaggtgcgattttcaaaattcccatcaacgggtgtgggacaccctggatgctgcagttcccacaagcaaacaggcgagggcgactctagggagagtcaccgcggccgtgggctggcccagccttgaggagagcattgacacacagcgtttgccagaaccatggccagggacgctgcctacttgctggaggtccctgctccttctggacagggatttatggttgggtgcattgcttagaataggaattagctaccatttgactgactttttggttttttgcttttttccccatctacgtcaagttcactgacttcattatctctattctacttttgagctcattcaaggttttgttgtattattattattattttagagggaatctcactctgtcgtccaggctggagtgcagtggtgcgacctcagctcactgcaacctctgcctccctggttcaagcgattctcctgcttcagcctcctgagtagctgggattacaggcacccaccaccacgcccggctaatttttgtatttttagtagagacgaggtttcaccatgttggctaggctgatcttgaactcctaacgtcaggtgatccacctgccttggcctccaaagtgctgggattacagacttgagccaccgtgcccagcctggctttgttttatcattgcggttattatattgttcagttctaaactttatttaaatttttttattttcatttatttatttattttttatacagggtcttgttctgtcacccaggctggaatgcagtggtgcagtcatggctcactgcagcctccttctgggctcaaacaatcctcccatctcagcttcccgagtagctgggaccacaggcacaagccaccatgcctggctaatttttaatttttttgtagatatggggtcttgctttgtcacccaggcaggtcttgaactgctggactcaagagatcttcctgcctttgcctcccaaagtgctagaattacagacatgtaaaatttctgtttggggctgggtgcagtggctcatgcctgtagtcccagcactttgggaggccgaggcgggaggatctcttgagaccaggagtttgagaccagcctgggcaacatagcgagacctcatttctacaaaaaaataaaatattgacagtgtggtggctcatgtctgtagtcttggctactctggaggctgacgtgagaggatcacttgaacctgggaggtcgaggctgtagtgaactatgatcatgccactgtactccagcctgggtgacagagggagaccctgtctcaaaagaaaacaaaaaattgtttggctcttctttacatcttctcttctttgcaaagactttctatatttccattgatttcaagagtgttggcctttcttgcaacattttgataataattgctttaaagtcttgatctgatatttccaatgttttgtcatctcaacattgaccactgttgatagtcttttctcctgtgagttgaaattctcccggctctttgtatgctgagtaattttggagtgtctccaagatattttaaatattaggatataggaatctggatctttatacaattctatggagaatgttgatatttttgttttagcaggctgtggtttttttttttttttttttttttggacatgctggacctaggaaccctgaatttccactaccttgctgtgtctccacacccttatcacagccctgcgtcatctcaggcagctctgaccacctcctgaatgtccatggcctgaccagaagcccttggagaactgccctatgggtttctgagttcctccctagcataagtgagtttggggctcagtaatgtcttggaaacaaacttgggtagacttgatgcttgttatggttacacaccctggttacacattatgctaagtgaaagaaaccagacacaaagcctctataatatgtgattattgattccatgattctggacatttcatagacctatgattccatgcctactttgaaatgtccagaataggcaaatccatcatgacagaaagattaatcacttagggatatatgaaatatatggaatagggataaagggtttggaatttctctttttgttaagaaacaggggcttactctgtcacccaggctggagtgcagtggcccagtcatggctcactgcagcttcaagcttctgggcttgggccaggcacggtggctcatgcctgtaatcccagcactttgggaggctgaggcaggtggatcacctgaggtcaggggttcgagaccagcctggccaacatggtgaaaccttgtctctactaaacatacaaaaattagctgggcttggtggcatgtgcctgtaatcccagctacttgggaggttgagtctggagaattgcttgaaactgggaggaggaggttgcagtgagctgagatcgcacccctgtaccccagcctgggtgacagagtgagactccatctcaaaaacaaaaataaaaaaccccaaaaacttctgggccggagtgatcctccctcctcagcctccagaatagctgaggcagctttattgagctataactgtttaccagtggttctgggttcaaattctaactccactagctgtgtgactctgggtgagtcactttaatccaccaagcttctgtgtcctgcgggttaatagtgtctgtggggggccagcctggcattggacaggcattcgagaagtgctaattattgtttttgaagcagctttattgacatagaagtcacatatcatacaattccccctttcaaaatgcacatttcaatggcttttaggatactcacagaggtgtgcaaccatcatcacggtcaattttagaacattttcatcactacaaagagaaactacaaacaagagctgggtgtagtgccttatgtctataatcccagcagtttgggaggccaaggtggaaggatcacttgatgccaggagttcaagaccagcctgggaaacatagcaagaccctgcctctaccaaaaaaaaaaaaaaaaatttaactgggcatgttggcatgcacctgtggttccagctactcaggaagctaaggctggatggtcacttgagccccaggagattagggctgcagtgaactatgatcgcaccactgtactccagcctgggtgtcagagtaagaccctgtctctaaaaaataaaaaatagaaaagagctgggtgtagcagcttacatctgtaatcccagcactttgggaggccgaggtgggcggatcacctgaggtcaggagtttgagaccagcctaaccaacacggagaaaccccgtctctactaaaaatacaaaattggctgggcgtggtggtgtgctcctgtagtcccagctactcgggaggctgaggaaggagaattgcttgaacccgggtggcggaggttgcagtgagccgagatcacgccattgcactccagcccaggtatcaagagcgaaactccgtctcaaaaataaaaataaataaataaataaataattgttactggccttgtcctccaagataaaaaggtctgatctctccccagtccatccagaacacagagaagggaaataattgggaaggtcattttggaccagactcatccatggtgatgttagatgggacagggaatgccacatccccaaaagcggtgaagccagacgtacagggtgctgggtcagatgctggagagagagcagggaattgtggctttggtggtcacggagctggggacatggggacagggagagccttgtgtgtgtgttcgctggtatgacccagcccttgggtagctctggggcctgggcaaggatgggctggatgaggaagccaggcaaggaagcaggtccatcctgccttgagctgatcgtctgctgcctctgtccccttgccgtccccgcactgtccctgggctggcacacctgcactgaagctcttctcagcatctcaccctgaagattctggcttctctggatgacttcgacccttttgtgctgctataaaggaatacttgaggctggataaggttttttttttttttatactttacgttctagggtacatgtgcacaacctgcagctttgttagatatgtagacgtgccatgttagagtgctgcacccattaactcatcatttacatcaggtatttgtcccaatgctatccctcccccttccccccaaggctggataaatttataaggaaagaggtgtatttggctcatggttctgcaggctgtacaggacgcatggtgccagcatctgctgctttttttttttttttttttttttagacagagtctcattctgttcctccagagctggagtgcagtggtgcaatctgggctcactgcaacctccacctcttgggttcaagcaattctcctgcctcagcttcctgagtagatgggactacaggtgttcaccaccacgcccagctaatttttgtatttttagtagagacggggtttctctatgttggccaggctggtctcgaaatctgcctctttatgagagacaaggtttcactctgctgcctggtgggagtgcagtggtgagatcctagctcactgctgcctccaactccttggctcaagtgatcctcccacctcagcctcccaagtaactgggactataggtgtgcactggtacacctggctaattaaaaaatgtcctttttttttgagatggaatctcactacgttgctccggctggtcttgaacttctgggctcaagtaatcctccccagccttggcctcccaaagctttggattcacaggcgtgagccacctcgcccagccagcacccgtttatggtgagaacctcaggaagtttccaaaggtgtttgcagatcacatgatgacagaagaaggtagagagagttggtggggagtggggcaaggaggtggcaggctctcttcaacaaccagttcttgcaggaactaagagtgagaactcgctcccttctgcaagaatggtaccaagccgttcatgagggatctgttcccagaacccagacacctcccaccagatccaactccaacactggggatcaattttcaacactgggctgggtgaggtgactcaaatctgtaatcccagcactttgggaggccgaggtgggcggatcacctgaggtcaggagtttgagacctgcctgactaacatggtgaaaccctgtgtctactaaaaatacaaaaattagctgggtgtggtggcgcatgcctgtaatcccagctactcaggaggctggggcaggggaatcacttgaacccgggagacggatgttgcagtgagtcgagatcacgccattgcactccagcctgggcaacaagagcaaaactccatctcgggaaaaaaaatttcaacatgagatttcaagtggacaaatatggaaaccataaaccatagcaccggcccctccacctccagttgccctctctcaccttctttcagccacacctcccaggccccaggtcctaccccagctctcccatgcctccgggcctttgccacatgtttttccacctaggaggtgagttcctcctactcactcacctgactctccccttcttaatttttctctccagtttttattttgcaaacttaaaaccaggctggctgggcgcagtggctcacacttgtaatcctagcacattgggaggccaaggtgggtggattgcttgagcccaagagttcaagaccagcctggccaacatggcaaaaccccatctctacaaataatacagaaattagctgggtgtggtggcatgtgcctgtagtctcagttaggaggctgaggtgggagggccacctgagcctggggaggttgaggttgcagtgaggcaagatggcgccactgcactccagcctgggcaacagagtgagaccctgtatcaaaaaaaaaaaaaaaaaaagaggaaaaaagaaaaacttaaaaagctacagaagcctgagtgcggtggcttgagcctgtaatcccagcactttgggaggccgaggtgggcggatcacttgagaccagttgttcaagaccagcctggccaacatggtgaaaccccgtctctactaaaaatacaaaaattagccaggcgtggtggtgggcgcctgtaatcctagctactcgggaggctgaggcaggagaatcacttgaacctgggaggcagaggttgtagtgagccgagatcacaccactgcactccagcctgggcaacagagcaagactccatctcaaaaaaaaaaaaaatctacggaaaagttgcaggaatagtccagtgaactttcagatgccctttgctccagttcaccaaacgctaacattactatggttgcagtctatctcttctctccctacatacacgcacttcgctttttcctgaaccatttgaaagctagatgaatacatcatgacaattgactgtccagaacttcagcatgcatctcctatgaacaggacattctccaccagaggttctggaacttgagcaacgttgagtactgagtcctgcccgctggctccttcaatgcccctttactgcccaagcagaagccaggaagtctccctagaggaggtgaggctggggctcagcttccctcctttcttcctttgatttcctccctccctccttcccttccttctttcctttctctctccctcccttgctttctccctcctccctgcctccctccctttttccttccttcatcccttcctccctccttcctttcttcctttttttttttgagatggagtctgctgtgttgcccaggctggagtgcagtggcacgatcttggctcactgcaaccttcaccccccaggttcaagtgattcttgtgcctcagcctcctgagtagctggaactatgttgagtgccaccacgcctggctaatttttgtatttttagtagagacgaggtttcaccatgttggccaggctggtctgaaactcttgacctcaggagatcctctcacctcagcctcccaaagtgctgggattacaggctcaagccactgttcccggcctcttctttctttcttccagctcttattttttaatttattttttaaatttttatttatttattattttgagatcaggtctcgctctgttgcccaggctggagtgcagtggtacaatctcggctcactgcaacctccgcctcccagtttcaagcaattcttctgccccagcctcctgagtagctgggattacagatgcctgccaccacgcctggctaattttttttgtattttaagtagagacggggtttcaccatgctggccaggctggtctcgaactcctgacctcaggtggtctgcctgcctcagcctcccaaagtgctgggattagaggcgtgagccactgggcctggcctacaggctttatttttaagaacagtttcagatttatagaaaaattgagaggatcatacagagttctgtgtatccccacactttctcctactattaaaatcttacattaatactgcctatttgtttcagttaatgaaccaatgttgatatcaatattgatacaatgttattaactgaagtgtatgctttatatggattgccacaggtttttttgtttatttatttatttatttttgacagagtctggctcggtcacccagactagagtgcagtggtgtgatcttagttcactgcaacctccgcctcccgggttcaagcaatcctcctgcctcagcctctcgagtagctgggactgcaggcacccgccaccacatctggctaatgtttgtacttttagtagagacggggtttcaccatgttgcccaggctggtctcgagctcctgacctcaagtgatcctccctcctcagcctcccaaagtgctgggattacaggcgtaagccaccttgcccagccacacagttttttatctaatggtctttttctgttccaggatctcatctgggatcccatatcacatttatttacatacaatttacacttacttacatactatttacatttatttacacatatttgcattcgtttacatatattgatttctatggctcttccccagtgttctgtttctgcttcaggagcccacccaggacaccaggtgacatttagtcatcacgtaacgacggctcctcttggctgccacagtgtctcagcctttccttgttatgacgatcttcaggttttaggagtgctggtcagctatatcgcagatgctcctgtcttgggatttgtctgatgtttttctcatgattagattaggattatgggtttttaggagaaagatcacaggtaaagtgccatttgctttacattctatcacgagtatagattattagcatgacaaataactactgatgttgactttgatctcctggctggggcagtgattgccagctttctccgctgtaatgttacccttcctgtgctgcaccccttggaacgaagtcaccctgtacagcccatactcatgttattctccccgccatgagggcagaagtatctgcatacattttttggagtttaaaaacttcttttaaactaaaaaaaacacttttttttttttcaggcagagttttgctcgtcgcccaggctggaatgcagtggcccgatctcggctcactgcaacccccgcctcctgggtttaagcaattctcctgcttcagcctcccgagtagctgggattacaggcgtgcgccaccatgcccagctaatttttgtatttttagtagagatggggtttcaccatttggccaggctggtcttgaactcctgacttcaggtgatccacccgccttggcctcccaaagtgctgggattacagatttttttgtttcttctttttttttccattttattttatttttttgagacagaatctcgctctgttgcccaggctggagcacagtggtgcagtctcagctcagtgcaacctctgcctccgggtttaagtgattctcctgcctcagcctcctgagtagctgggattacaggtgccttccactatgccccgctaattttttgtatttttggtagagacagggtttcaccatgttggccaggctggtctctaacttctgaccttgtgatctgcccacctcggcctcctaaagcgctgggattacatgcatgagccatcacacccggcctccattttatttttgttttattcacaaagaccccaataacaactattttaattttttgttggttggttggtttgtttttgtgacggagtctccctctgttgcccaggctggagtgcagtggcgtgatcttggctcactgcaacctccgcctcctggattcaagcaattctcccacctcagcctcccaagtagctgggactacaggcatatgccaccacgcccagctaatttttgtacttttagtagcaacggggtttcgccacgttggccaggttggtctcgaactcctgacctcaagtgacccaccaacctgggcctcccaaagtgctgggattacagttgtgtggcaccacgtccggcctaaaatctttaaaaaaattgtttttttttttttgtagagacagggtcttgctatgttgcccagggtggtctggaactcctgaccttaagtgattctctcacctggacctcccaaagtgctgggattacaggcgtgagccacctcgtctggtcccaccagtgatttctgattcctcagtgtgactgcaaggccagtgagccccaggccctgaagacatcacacaaactgaagcctggaggtttttatggcagccaaagcttggcaatggctgatgggacaagtgagggccttcccttcctgatgtcctgggaccgcatatatccaggtcagagtgggagctacaggaaggactgactgtgagttctctgccagcctgctgagatggcaaagaatgggaatgaaattgactgaaagaaaataaacatggatgcttgttgcacggatgtgggtgaggagagccagcctgtatggggacatggggatggagactgatgctgggggggtagtgacaccaactgggtggcagctggcaggcccctgggcatccacactccccctgctcagttggagagaagcaagaaagcataaagggagggagggagggaggaaaagaggtgggagatgagtgctgtgggtgagcgctgaagcacacttcaaaagctcaagccacaatgcttacgccctgatataaaaagagcattgagttgagcgtggtggcttacgcctgtaatcccagcactttgggaggctaaggcgggtggatcacttgaggtcaggattttgagaccagcctggccaacatggcgaaaccctgtctctactaaaaatacaaaaattagccgggcatggtggcgggcgtctgtagtcccagctactctggaggctgaggcaggaggatcgcttgaacctgggaggtggagcttgcagtgagtggagatcgcgccattgcactccaggctgggtgacagagtaagactctgcctcaaaaaaaaaaaaaaaaaattgaaaaattacaaagctcaaacctaatcaccagtgtggctgctcctggccccaccctgcctcctgctccccaggggaggggacaggtcagagaggggtgtgcccttccaggggcctgagatgatccagacatgggagctggcagggaatgagggctccggcagggctgggtcagtaggtacacctggcaatagggcaaagatctggcagctggacttcttgggctctgagaaggcaagagattagtatctgtgtgtgacaggagagggcgtggctggtgtccacccatccatgctgggagacgtgggagagatggggcggggacacagggcaggagagaggccaggcctggggcctctgtgccgggagggataatacgatctctgagtcaccccgaaatggggtgagatggtgctgatgatcccggattccttggttttgtccctggctctgtcactgctgactcatgggctgccgacctaggagtctcctggtcagcgtgcgggtttctctcagcctcttggtgtgtcacagaagcagacagcttctctgtaaaccgtcatcctcaggggtgtgcccggcttctgggttctgtgttctggcatcctccgatattccaagaggaagcaggataggacgatcccagctccttgctctgcctactggtgacaagacctgtcctggcctgggaccaggggggcttctctgggagtcctggttggtcctgagacagggacaccctcccagtgaagccctacctcctctgtcctccatcacccagcccacagcaaggccaccctcctgactctccctccaattaacccaagctcctgggttgcgcccttgaggcccacaccgatgctcccaacttactttccagccctattccctcacctgtctggcttccgactcctcaagttgagttttccacagatacttcctccccacacacacacccgtttttgtccctgctactctccttttgcgagagctctctcctcttcataggtctctaagcttttactcacccttcaggtctcctctccacctgccacctcctccaggaatcctgcctggtgtgccccaggtagagttgatttttcactctccagtgctcacacagagcttgttttccctgcgtgggagctgtttatttaaattcaggctggcctgattacaccctgatgagctccatgccagccctgggcctggcccagtgcgctcagcatgtccttccagaaagaatgaaggaataaaaaaagacgaagagtaataaataggagagtaggggtagaggatgagccccagaatcagacattaggcagggtgtggataccagtcttgccattattctggtggccctggaatgtcacatcagttcccagagccttagttttctcatctctaagatgggaatgggctaggcatggtcacacctgcaatcccagcactttggaaggctgaggcaggaggatcacttcttgaggccaggagttcgagaccagcctgggcatcatcgggagaacctgtctctacaaaaaaataagaagttagctgggtgtggtggtgcacacctgtagtcccagctacaccagaggctgaaggtggaggttttcttgagcccaggagtttgaggcttcagtgagctacgactgtgccactgcactgtagcctgggtgacagagcgagacttcatgtcttaaaaacaaaaacaagagaacaacaatgatgcccctgcactgttttgcagtgagataaaatgacttcctgttattcaatgttatccgaaggcatttaggttagtgcctggccccgaagcaggtgctcaaaacatggtttactggctggcttgctccctgagaggccagggcagaggtgcctggcaggaggaggctgccctgaatggggagagggaggggtggggctggagaggattgactcctccatcagattagagggtcttcaggaattccaccgcccttaggtcctcttcctccctcgcctctgggaaattggagtaaaatccagtagagacaggactgccctgaagtgaggaggcgggagccggagggagtcggggaggtgggtgggaaggagggtttatggacctccctgtgaagtgggggaatggcctgtgaagggctggacagctgggtaggatggtgggaatgctgaaggtcacggtaaatacgggcttgctaattatttatttattagagatgaggtcttgctctgtcacccaggttggagtgcagtggcatgatcatggctcgctgtagcctccaactcctgggtttaagtgatcttcctgcctcagcctcccgaatagctgggatttacaggtgtatgcgaccatgcctggctaattaaaaaaaaaaatttgtttttgaaaaagggtctcactatgttgcccaggtaggtcttgaattcctggcctcaagtaatcctcctgcctcagcctcccaaagtgctgggattacaggcatgagccaccatgcctggccaggtgttttgaaactgacagacataaactgaaatcgatgcaccgatttggggtaaagtaatttaacaacggtcctctaagtcctgtcccctgtgtaagcctcctccccttcacacagtcatctcttctgagtctctctaactaagctctctcaccgagtcccctccctttgctcagcccctctccccatccttgccaccagaagtgccagaccctgggactccagccaggaggcatcagtatggtctttcttctcttccttagaagaaaccccagaggtggccaccgcccccacccacggcccacgtggtgcccaacctgggggcagcacccgctcagccagtctcgccagactggtcagccaggcctgccatcacccagcaccaggccgagggggtggatggtccgctggtgtgggcggtcaggctgagggccagggactctcctgttcagcctggtgccaggactccaatctgagctcaaggacttcagaaagaaataggatcttgttgcctaaagaaagaaaaaaattccatcctttactattttttattttttgagttggagtctcactctgcctcccaggctggagtgcagtggcgtgatctcggctcactgcaagctccgcctcccaggttcacgctgttctcctgcctcagcctcccaagtagctgggactacaggtgcccaccaccatgcccgactaattttttgtattttgagtagagatggggtttcaccatgttagccaggatggtctcaatctcctgacctcgtgatccgcccacctccgcctcccaaagtgctgggattacaggcgtgagccaccgtgcccggcctactgttttttattttttaagagacaggatcttggtctgtcgctcaggctggagtgcagtggtgtgatctcagctcactgcaacctctgcctcctgggttcaagcgattctcccacctcagtctcccgagcagctcccgaccacaggcacacgccaccatgcccagctaatttttagtatagacggggtttcaccatgttggccaggctggtctagaactcttggcccaagtgatccttccacctcagcttcctaaagtgctgggattacaggtgtgagccactgtgtccgccctaggaatcaatttaatatacactggcttccctggctttagtcttcctgttcccagaagacgtggagtacgggctctgggagctagactgctcagctcacagagatctttttggctgcaggacagtggtccatcactggccctggggctcagatgccagcgggagcttggggttagaagggagactttgtttttgcccctttgctagggactcccagggagctgaactcagggcaagctgcatgtgtgtgtgttacaactggggacttggggccaggcggggtagctcacgcctgcaatcccagcattttgggaggctgaggagggcagatcacttgaggctagaagttcgggaccagcctggccaacatgctgaaaccctgtctctactaaaactacaaaaattagctgggcgtagtggcgagcacctgtagttccagctactcgggaggctgaggcaggagaatcgcttgaacctgggaggcagaggttgcagtgaaccgagattgcaccactgcactatagcctgggtgacagcgacattccgtctcaaaaaaagagaacaaaacaaaacaaaacaaaacaactggggacttggccaagcccctggaactctggggacaggggtctgaaaagtcctagctcccacctgttatgatcaggatccgaactgcgcagcagctgctttgcgtacggaactttgctccctcctcttgttattaaactttttggctcacaaagcatttttacttccttctctcatttcatgtgtatctcagactggggagtgggccccagtgttctcattgtacaaaggaggaagttggggctcagagatggaattggcttctccaaggtcacagggctggtaggatggcttatggatacacagcttcccagcttttgtcctgagctttttggctcatgaagcattttcacatccccatctcatttcacgtctgtttttgtttttgatcctggagggggtgcaacatcctcatttttacaaaggaggaagctgtggctcagagatggttcctgggctggaaagatggtttatggggtgggcagagatgggtgagctgatctggtggtttttatccttgatagaaaccagcaggtgtggccaggcgcagtggctcacgcctgcaatcccagcactttgggaggccgaggcgggcagatcatctgaggctggaagtttgagaccagcctggccaacatgctgaaaccctgtctctactaaaactacaaaaattagctgggcgtagtggtgtgcgcctgtactcccagctactcgggaggttaagccatgagaattgcttgaacccgggaagtggagactgcagtgagcagagatcgtgttgtctcaaaacaaaaaacaaacaacaaaaacaacaaaaaacaacaacaaaaaacaaaaaaaagcacgtgatccaattctgtcagcacaaaatcacacagtgcatgttataaagaagaaaaagaaaataaatgagtgccaaccctgtactctctgaccccaaaaccaaggtgatgaatggcagatgtcttataaggtgttcctgtaaaagatcttcgggctttgggaagagggccagatgcaggcctagaggtaaatttccttgttttcctctgccttagggctatgggagctggagcggagaggagagaagcaccttgcctttgctggtgtttttcccgcagcaggtgggtgggactgagccaacggtctcttggcatcaacaaagcatcaacaaatctctctccagctccacttgtgctgagctactggctgatccccaaggacatccttctggcctctccttcacacctgggtcccctagccctgcgtgagctctgtgcttcttcccctgccctgtgtctgctctatgcctggagcctctgtacctgccctctcctcaacccccaacccctccctgctctcagctcccgatacgcgtggctatgcctgggagggaaggacagcttcttagggccacaggtggactgttgtagggcttgcatgctcccctcccccatgcctgcttctccaagtggcacttggctgtgtcccaggaaagcaagggcaggaagtggcagggcgggggccgggggccgggggggcaggaggcgggcggggggttggggggggcaggttctggccatctggccaagtcacgtgtctactcagaaagcttgttaaaggctacctggctgggaccacaggtaagaggcacctggggaaggaggcacccatgctggagtgcccacccgtcctgggcaaggccctggccttctctgggcttcagtgtactcctttgagccaaggcaataaaagtccctgccctgctgactggcaggaggctgtgatgaggtcatctccaggaaagcacttatcgccaatcatgatgttacttatctctggtgttattcagcccataggctctgtgtgtagagggagccttgtaaagaaagccccagggaggcgtggtctgggcagaaaccatctctgtttgctttggtgtgtgtgcctatgatgggggtcaaggtataggagtgtgatttgaaactggagaatgcttcgttctttccatcatcaaacatgtctttttttttctttttttttagatggagtctcgctctatcacccaggctggagtgcaatggcgcgatcttggctcaccgcaacctccatctcccaggttaaagcgattctcctgcctcagtctcctgagtagctgtgattacaggcgtgcgccatcacacccagctaatttttgtattttttagtagagatggggtttcaccatgttggcctaactcctgacctcgtgatctgcccatcttggcctccgaaagtactgggattacaggtgtgagccactgcacccggcccaaacatttctttttcttttcttttgagacagagtcttgctctgttgcccgtggctggagtgaaatggtgcgattatagttcactgcagcctcaaactcctggccttaagcgatcctcccatcctggcctcccaaagtgctgggattataggcatgagccgcagcaaccactcctcacatttcttgagcatctgtgatgtatcaagccagatgctgggcactgaggttgcagaaggcattgttcctgtcttctaggagccccaggctagcagggaagacggatgtgtatagagttaaccacaataccaggcctcaacttcccgtctgtaacacaggtggaccatgctagattgtcccagcctgccctgtgcttcattagccggtcaacagatccatctcaaatacctcccatgggtactcactgattgctttaacccaaaccatggcactcttgaagactttccctcaggaagctcaaggactatgcatccttctgggtcagaactggacacacagccaccagtgctggacaatggcggcggctcagggacacactggagccctggcccctgcagagctcccagcatggttgggaagagagatgcaaaatgaccacacggcgggtgaggaggagctccctcggtgcggctgggatgagccctagacactctcaatcacccccacgatgaccccttcccagaggtcccctcagtcatctgccctgaaccaagctcttcctgatcctagaccctccaccctccctctatcttccagggcttggtgacattccaggcagaaatttctgacccttttactttggtccctccctccccagcccagtctctggtcaaactggattcctggctgttcccagaacgagctgcctttccccaccttgccacctctgcccttgttctctctgcctgaatgtcctccttcactagcctcgctgccttgcacatctctcctgagggctgtcatcccagaatgagctgcatttgtccagcctggcccaccgtctaccagaacgtcctccttcagcctgtcccactgccttgcaaaacttttctgggggacctgttcacgatgccttctgtagcatactccaagaatccggcgccccctggagttgtgccacacagcacccctttgcagtcaagctccctcagcaccaccacctccaccctggaagagttccccttccctttgaaatctcatgggactttgcacccactctggctttattggaaggctttgtatgtctccacagggtaaacacccatttactggggtgatgatgtctccaggatctagttcatgtttgtcgttggtgactggccccacccagttctgggcaagcaggctggatcccggcaggaacagagcccaccagcctaaacttccatggaggtggagaggggacaggcttctgtctctttttggctgaaggtgcatcatgtccaaggcccctcttctagccaagcagagaagctgggtgataaggatgggtgagagtgggtgatgtaccccggagtcctggcctcccggctcctcactcccctacacgtaactttatccggccaatgccgcaaagactgctggtgaggccagatgcatgagtgatcatactcacaacagtcgtgaaactgccagtgatgaaactggtaaggacaagaaatgacaataatcaaggtggggtttctcgtggacgtttccaagacttcattctcaaattctctccctcagggtccccaccctgtcctcccacctaagcctggaatgagggggcactggcctgtggggaccctggtcttcaggctcccaaacctggctgggtctggttgccccctggccttaacctgtgaacatccagctgtccctgggctgtgattcagtgtctgtctcccgggtgacctcagcatgggctttgaggaaggggagagagtagtttcttctgagactggatagtgactcagggacccggggctggggcctcaaaagtgcctttgttggcctgggctcaggaatccagagaaactggtcaggaggaggccccagtgacaaaaacccctccctctgcccccgcccctctgccagagccatataactgctcaacctgtccccgagagagagtgccctggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggagg

SEQ ID NO: 7 - DNA, 34999 bp, Homo sapiens
gggcgtgagaggcggggcggggccgcgctctgcttgccaatgtctttataggtcacccggaaggcacgcggaacctcggcgcggtgcttccagcagggtctctccgccactccagccccgcgcccctcgccgcggccctcgggcgtctgcgccgcagctgccgcccccgcctctttggagtctctcgcggcctcaaagcgcggcctgcgtcgcttccggcagttcccgaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcaggtagggcgccgtgcgggcgcgatcgccggcgcgggccggggtccccggtgggtggcgcctggctctctgggccgagtctctggttccagtgccttctgcgcgccgggcccacaccccggaggcctgcctctcgcccccctcttctggggtgctctcgcggctccgtctcgctgctcggtggcgtcgctgcctcccttccgtcgcaccgcagagttcctttccgcatcacccactcccggcgggaatcggggaccctggacgcccagctccctttcccagcgcttcccgtgccctgaggaaagccgggactttgctgctgcttgttctccgtgtgatttgtctgggatctgacctttgctctgcccgaaactggcagtgaccttcgcgacaggcttccctcctgctgtcctggcctgacacacctgccagctgtttttttcagggccttgccctgctttgagaggacacccaggtcccaggtctttgtcagggggtgtccaggtagaatacacccagcccataccctctgctgccctgtaggccctttgctagttgctcaagtgttgaaagcccctgcgttgaagtaatctgccgggacttgaaacttggctttggcactgattgtctgacgtgcctaacttggtcagtccttaggaacccagtttctccatttgcaagttggatataataacagtgtagacctcctatggttaattgaagaatcaatgagttaatacagcgatacaggtagtcttgtgcctagcacgtaatgagggctcagtagatgccacttggtagcagcagcagcagcagcagcagcagcagcagcagcttcttaggttcacaatgttaagagagttttgtattaaatattgaaagaaatgtgacaatttatcccaaatgtgttgaagttttaggttcttgggcatatttgtttttcaaagacactccttagatatactagagatacaatttacacataatttttaccaacatggtggcgatttatataatgcagatctctcgacagctctttgaccgcatgatgtagggtagcaggaatcgagaactagagggagagtgtgttggatttgtacgctgctttgtctagtttctttttgaggtctctgagagcagggtctaagactttcagtcatcttttccccactaatcccgttatctagtgggtgctccatacatttttgttgtgtgaactttgggggaaatcagggagaaggcaagccagatttatttgttcctgtttcctctgcacttccccccctgtctttgaccagtgtgggtaccttgctttctgttatacaatggatgagttttggacaactgaatcaattgggacagatattgaacatgcttgtgtaactggtataagggaacatgaatgtttttgtagtaattgggagttatctttctcagatttgttttttggatttggatatgtcaggttgttttaaaggggagcacgtctatttcctcataatcctgctgccctctttattggcacaatttctattcatggtcttatcattcctcttacagactttggagctacaactggattttccagttcttactgtgttaatgagacttgtgctgtaactaccgtaactactaatcacatgtggctattgaagtttaacataattaaaggtaaataaaattaaagattcaatctcgtagttacactagccacatttcgagttctcagtagccacatgtggctagtggctactgtattggacattgcaagtatgtgtagaacatctttgttatggcacaaagttcttatagacagacagagcagttctagaaactgtagttctgtctttgaagtttaacaactcgataagctatcagtaattgagagtcagaaaaactccttttactctaaaataccgtgacacaagggggtttgcagtgattcaggtagcaaagatctttcacgtgtattgtttcgtatgactcttaagacaattctatgaggtagggagggtagataaatgggaataaaaatttcatattaagtagctggcaaaactaggactagaactcaagaagtttttgcggattttaaaaaaattttaaatttctatttatttttaaaatttcagtagttttgggggcacaggtggtgtttggttaatgggttagttctttagtggtgattttggaggtgttggtgtactcttcacctgagtgcagtggtgccatcatggctcactgcagcctacacctcccaggttcaagcgattctcgtgcctcagccacccgaatatctgggattacaggcgcgtgccaccacactcggctaagttttgtagttttagtagagatgagatttcactatgttgaccagcctggtctggaacccctggcctcaagtaatctgcctgcttcagcctcccaaagtattgggattacaggcgtgagtgaccactcccagcatagggtctacatcttctgactcttaggttccatactctttcaacttaagaattacatttttctttcgtttccgcctcctctcctcttctttggtaaacctgttaatactcttacttggcagttttttgtagggctgtttacctttaatacagaccaacaggttgggcttcttagcaaaagggcttggtctttaaataacagttattaatcagtgtgtgttgaattctactatgtgttacgtattttgcatacattgtcagaactataagattaatgttgtccaattttatagaagaggaggctgatgtaagagatttcgaattcctttgctgtaagcttagctctagagtgcttcagaagaacagcaacgctgaaacctctggctttcagtagtgtgtataaatgatggaattctttctaatgtgcttcctgtagctttagctaccaggcattcgttgatgtcaaatctctagacttctctgctgggctcagacccatacccatattgccatctggtgtttggacattctcatctggctttttcattattaaattcagcaggtctaagcttcaacttatttctgtcttccccaaagttcctttggttcctgtcttaaacctaggttaaatggtaccacctaattgtgtgagctggaaatcccaatgtttttctttccgcttttcagtttatcttatgtagatggtcactaaaaccttttggtctacctcctggatgtctgttaagtcactgcattctctgtccctgattagtttatgctgttttgataacctccaaagtggcctccctgcctctagggtattttcattctcagccattgtactttgaaaaaaatggcagttattcatgttgaaaattatgaataatatgtgggaatactagttttaaagcatgttttggctgtgaaaagaagttggagagcgcaggcccttttgaggaacattctggtacacacacacacacccttttgatgagttttaatgaatagaatcctgttttttttcccagtgttataatattagggagggcattatcccagtggggcttcagttgcctcatttgtgaaatgggatcactggacttgataactttcgagatagttatggctctgaaattatttaattctgagttttacttaaagatttgtttgatgggctattgccatctactggtagtaataagaataacaactcattattttaagttgaagagaatcttttcaagtgtgaggtaaaaattaaaatgaccaatggtggaggaataaggatctagtttttagtataatggcttctcaaattttggagggatgtttgtgagaagtgaaggaaatttaagtcagctagctgatagttaacatactatcttaaaaaaacatgtaaggaggtatttatcttacagattcaaacaaataaactttttctagtccctttgatttgtaagtatacaatgtggactgaaatgagatgtcaaatacgcagaaaactactaaacaacatctctcagcagtagtattctatgtagcactggaaaagcaatcgccctattgatttttttttttttttttttggagacagagtttcactctgccacccgggctggagtgcagtggtttgatctcggctcactgcaacctctgccttccgggttcaagcgattctcctgcctcagcctcccgagtagctgggattacaggcatgtaccaccatgcctaatttttgtatttttagtagagacggggtttcgccatgttggccaggctggtcttgaacttctgacctcaggtaatccgcccgccttggcctcccaaagtgttggaattacaggcgtgagtcaccatgctcggccatgatttgctttttagaagctcactacaaccctggtctagtcttttatggacacattcatgtttttcagagagctgtgtgatgactttttttgtttttttttttttttttttttttgagacagggccttgagctgttgcccaggttagagtgcaatggtgtaatcacggctcactgcagccctgaacttctgggatcgggtgatccacctcagccccatgagtagctggtactatgggcaaataccaccatgccttttatttttcatacacctacaaccatctcatttttatttttattttttgtagcaatagggtctctctgtgttgctcaggctggtctcaaactcctgggctcaagcagtcccctgcctcggcctcccaaagtgctaggagtacaggtatgagccaccacacttggccttttcttttttaaatgacagggtcttgctgtgttgcccaggctggagtgcagtggtgcaatcatatcccattgcagcctcttcctcctcctgggctcaagggatcctcccgtttcagcctcccaattagctgggactacagatcacatcaccacacctggctaattattttattttttgtaaagatgggatcttgccatgttgcccaggctggtctcaaacttctggcgtcaaacaatcttcccacttcagcttctcgaagtactggggttacaggtgcaagctactgcactggcttgtatgagagtaaaatagagttcatgagtgataataattgccaaatgttttataactgtgactattagggagacatatactgaggccaccaggtggcgttgaccaggtagtcattgccatttcctgtaaggtagtagagcttattacctggtaggtgggtagatatatatgcctttgatttccaaataagctttggaaagaaaagaaaataccttcggctaggcatggtggctcaggcctgtaatctcagagttttaggaggccaagttgagaagatggcttgaggccaggaatttgagaccagcttgagcaacatggtggcaccccgtcactacaaaaaataaaaataaaaaaaattagccaggcgtggtgctgggcacctgtattcccatctactctggaggccttataggcttttaaaccaattattttaaattatgttttgaaattactaaaaatactaaaggactgtttttttttccagctcagaagataaaataacagtccactttataaaccgtgatggtgaaacattaacaaccaaaggaaaagttggtgattctctgctagatgttgtggttgaaaataatctagatattgatggctttggtgagtatgaaacatttcttaaaatgcataagtgaaactgttaggtttcaaatttttattttgtggtttttttttttgaagaagtttaacctatagcatgctatgtaaaatattaacattcaggatgtgttagtgttatattcttgtttataaagaataatagagtgacaccattgttctgttctttgtacatttaaataagtcatggccagaaatctgctgtggcctcattaccttactgtttatatgtgtgatacaaagccgacggtagggagtagagttaaaagataccaggttagagagaataaatgtcatagcacagaggggtacttaaatatcttgaatgtcagctcaccttcctaggaaaggtaacttatcctagaaagtgatttatttagaaagttttcatttttagacttctgaccatatgccttaactacacgtgcaaagcctgtgttcctgcaactgcccttttacacttcctcaggcgtaccctgtatatgacctgtcagttttgttcaagcaatgcatgtttagattagcagttctcagagggtttccttgaccgttagcattagtgtcacctgggaaatgcagattctcagacactcctcccccacccaccgcccccacccccgccccagacttactgagtcacaaagtctggggtaggtccagcattgcatgttgtaacagctgtctgtgtgattttgatgcatgttcaagtttgagaaccactggtctggaataaggttcaaggagcgtatctgactctgcttctttcaaggcactgttcacattatcctttaaagaaccatttctagatcagaattaatttatctctcttctgttttcccatgatatattaaatctacctctctttgttaatgcttataacagttttcctttttagagagaatggctatctttcttattagattattagtttttgaaagactgtactccatgaggttacctgagtcacctcatggagtaggctttgtccagagttggcactcaataatatttgctgaatatctttttaaaaattttttgagacaggatcttgctctgtcacccaggctgaagtgcggtcgtgcaatcacagttcactgcagcctcgacctcctggactcaagtgatcctcctgactccgcctcctgagtagctgggactgcaggtgcaccatcacacctggctgaattttgtattttttgtagagacagtgttttgccacattgcccagcctggtcttgaactcctgggctcaagagatcttcctgccttggcctcccaaagtgctggcattacaggcgtgagccaccatgcccagccttgaatactgaatctaagtattttttgctagttttaaaataattataacaactagaatttgagtgtatactatattctagcatatgttaaatgaagtagattttttttttaactctccatttgatagttgaagaaacttgagtctcatggaaattaagtttccctggttatacatgcagcaagtgagagggctaagactcaaacctgtcttgaagtcaagatggtatatctcattgtggttttgatttgtatttctctggtgattagtgatgttgaacatttttccgtatgtttgttggccgcttttatgtctgtgtcttcttttgagaggtgtctgttcatgtctttttattttccaacttttatttagattcagggagtacatgtgcaggtttgttaaatggatgtatcatgtgatgctgaagtctggagtatgagtgatcctgtcacctaggcagtaggcttagaaaccaataggtagttttcctccttgcccctctcccttccccctctggtagtgcccagtatctactgttcccaactttatgtccatgggacccagtatttagcttgcacttataagtgagaacactttgcttttctggttctgtgttaatttactcgggataatggccttgagctgtatccatgttgctggaaaggacatagttttattctttttatggctgcatattccgtggtatatgtgtattacattttctttatccaatccaccattgacaggcacccagactgattccatatgtttgctattatgaatagtgctgaggtaaacatacgagagcatgtgtcttttggtagaattatttgttttctcttgggtatgtacccagtactgggattgcttggttgaatggtagttccatttttagttctttgagaaatctccaaactgctttccacagcagcttaactaatttacattcccaccaggactgtcttaagtgtttccttttctccgcagccttgccaacatctgtaattttttgactttttaatgatattctttatgactggtgcaagatggtatctcattgtggttttgatttgcagagtggagtattttttcatgtttcatgtttgttgaccacttgtatgtcttcttttttaaatatttatttatttatttttgacacaaagtctcactgtcacccaggctggagtgcagtggcgcagtctgggctcactgcaaccttcgcctcccaagttcaagcgattctcctgcctcagtctcctgagtagctggaattataaaggtgtgccaccacggctagcaaatttttatatttttagtagttttatatttttataattttatgattattttcaaattttatatttttagttttgccgcattgaccaggctggtcttgaattcctgacctcaagtgatctgcctacttcggcctcccaaagtgctgggattacaggcgtgagccaccatgcctgacttctgcccgctttttaatgaagttatttgttttttgcttgttgatctgtttaagttccctattgattctggatattagacctttgttggattcatagtttgtgaatattttctctcattctgtagggtgtttactttgtttttttgtttgttttttgagacggagtcttgttctgtcgcccaggctagagtgcaatgatgtgatctcggcttgctgattcacctccacctcctgggttcaagtgattctcctgcctcagcctcttgagtagctgggattacaggcactcactaccacgcccagctaatttttgtatttttagtagagatagggtttcaccatgttggccaggctggtctggaactcctgatctcaaatgatctgcccaccttggcctcccaagtactgggattacaggtgtcagccaccatgcctgctctgcccacttccccccaaccccgagacggagtctcactctgttgtccaggttggagtgcagtgctactgtcttagctcactgcacccttcacctcctgggttaaagcaattctcctacctcagcttcccgagtacctgggattacaggtgcatgctaccatgcccggctaatttttttgtatttttagtagagatggggtttcccatgttggccaggctagtctcgaactcctgacctcatgatctgcccgatttggcctcccaaagtgctgggattacaggtgtgagccaccacacccggccctctgcccactttttaatgaggttatttgttttttgcttgttgatctgtttaagttccctatagattctggatattagacctttgttggatgcatagattgtgaatattttttctcattttctagggtgtttactttgttgatagtttctttaatgtgtcgaagctctttaatcaggtcccatttgtcaatttttgtttttgttgcaattgattttgaggacttagtcataaaaattctttgccgaggccaatttccaggagagcatttctgaggttttcttctaggacttttgtagctttagatcttacatttaagtctttaatctattttgagttaaattttgtatacagtgataggtaggggtctagtttcatttttctgcatataatagccatcaatcccagcactgtttactgaatagggagttctttcctcattgcttatttttgttgactttgtgaaagatcagattttctagatgtatggctttatttttcgggtctctattctgttcctttggtctgtgtgtctaggttttctaggttgtgtgcataggggtgctgataatagtctctaggatctttgtatctttatgggattggttgtaatgccatctttgtcatttctaattattcttatttggatcatctctttttttttctttgttaatctagctagtggtctatccattttgtttattctttcagaaaagcaacttttggttttgttgatcctttgtatagatttttgggtctcgattttgttcagttctgctttgagtttgttatttcttctgctagctttgggttttttgtttttcaagttcttctaggttaattttagattgttaatttgagatctttctaactcctcaatataggcggtcagtgctctaaacttcatcttagcactacttttgctgcatcccagagattttggtatctgtgtctctgcttttatttatttcaaagaattttttgatttctgccatatggtggagccactttagctggtagaaatattttctgatctttgacagaatgggtaaaccatgctattgtttgtgtgcattggaagttgtggctgttgtgctgttgaaaaaatttaaatcttaatatctcataacagtgttaactaaactttcatttagtgatggtgtggtactgaaatatgtcccaaatcaataacattggaatggatgctaaacatgatctaacacaaaaaaaggctaaacaatcagcctgacgtttggtgctgttaatttaggtgtagatactgtaaagacaaaagtacttagaaaataggattttaaaaagacattacggtaggaatatttttaagctcacaaaaaaatcacttggtgaagggtaatggaaaacaatactggtggtctggctgtgtccacacccaaatctcatcttgaattcccacctgttataggagggacccagtgggaggtaattgaatcctgggggcaggtctttcttatgctgttcttgtgacagtgaataaatctcacaagatctgacaattttataagagggagtttccctgcacaagctctctgcatgcctgctgccatccatgtaagatatgacttgcttcttcttgccttctgccagtattgtgaggcttcctcagccacatggaactgtaagtccattaaacactttttcctgtataaattacccagtttcggatatgtctttgtcagcagtgtgaaaatggactaataaagcaaattggtacgaggagtagggtgctgctgaaaagataccccaaatgtggaagcaactttggaaccaggtaacaggcagacattggaacagtttggagggctcaggagaagataggaaaatatgggaaagtttggaactccctagagacttgtggaatggctttggccaaaatgctgataacgatatggacaatgaaattcaggctgaggtggtctcagatggagacgaggaacttgttgggaattggagtaaaggtgactcttgctatgttttagcaaagagactagcgcattttgcccctgccctagagatttgtggaactttgaacttaagagatgatacttagggtatctggcagaagaaatttctaagcagcaaatcattcaagaggtgacttgggtgctgttaaaggcattcagttttaaaaggaaacagcataaaaaagtttggaaaatttgcagcctgacaatgtgatagaaaagaaaaccccattttctggggaaaaattcaagctggctgcagaaatttgggtaaggaatgaggagctgaaagttaatccctgagatactggggaaaatgtctccagggcatgtcagagatcttcatggcagcccctcccatcacaggcctggaagcctaggaggaaaaagtggttttgtgggctgggcccagggcccccttgctgtgtacagcctagggacttggtgctctgtgtcccagctgtcccagctgtggctgaaaggggccaatgtagagctagggccgtggcttcagagtgtgcaaacctcaagccttggcagcttccatgtggtattgagcctgctagtgtacagaagtcaagaactggggcttgggaacctccgcctagatttcagaggatgtatggaaatgcctagatgttccaggcagtagttttttgcagggcagggctctcatggagaacttctgctagggcagtgcagaagggaaatgtggggttggagcccccacacagagtccctattggggcaccgcctagtggagctgtgcgaagagggccactgccctccaaacctcagaatggtagatccactgacagcttgcatgatatgcctggaaaagccacagacactcaatgccagcccatgaaagcagccaggagggaggctgtatcctgcaaagccacaggggtggagctgcccaagaccatgggaacccagctcttgcatcagtgtgacctggatgtgagacatgtagtcaaaggagatcattttggagctttaagatttgactgccctgctggattttggacttgcatggggtctgtagcccctttgttttgaccgatttctcccatttggaatagctatatttacccaatgcctgtacccccattgtatctaggaagtaactaacttgcttttgattttacaggctcataggcagaagggacttgccttatcttggatgagactttggactgtggacttttgaattaatgctgaaaagagttaagactgttggaaaggcatgattggttttgaaatgtgaggacatgagatttgggagggaccaggggcagaatgatatggtctagccatgtcccctcctatccagacctcatcttgaattcccacgggttgtgggagggacccagtggtaggtaattgaatcttgggggcaggtctttcccatgctgttctcctgacagtgaataagactcacaatatctgacagttttataaggggaggggggttccctgcacaagctctctgcctgacgccatccatgtaagatgtgacttgttcctcgttgccttctgccaggattgtgaggcttccccagccattgtggaactgtaagttcattaaaccctttttcctgtataaattacccagtttcaggtatgtctttatcagcagcatgaaaatggactaatacaattggttacatagttgaagacacaaaactgtggcagtgtacctcagtctgcaatggctgatgtttatgggtgctgaaaattcatctttacccctgccctgccccgctaccttttttttttctgtaggaaaatgtctcaagttttaaattatgtaaagctttcagcactagcatctttggtataaaaaaagatgatgggatttagattatcttccctccccaccacatcatttaacatgccgtctgtggtttttggacttaataatatcctttttttttttttttttttgagacgtagttttgctctttttgcccaggctggaatgcaatggcacgatctcggctcattgcaacctctgcctccctggttcaagtgattctcctgccttagcctcctgagtagctgggattacaggtgtctaccaccacgcccacctaatttttaaaatatttttagcagagacggggtttcaccatgttgggcaggctggtttcgaactcctgacctcaagtgatccgcctgccttggcctcccaaagtgctagaattacaggtgtgagccactacgccttggccaacagctaatgccctttctgattggtgtgagatggtatctcattgtggttttgatttgcatttctctgatgattagtgatgtggagcatttttttcatgtttgttggctgcttgtatggctttttttgagaagtgtctgttcatgtcctttgcctatttttttaatgaggttgttttttgcttattgatttaagttccctatagattctggatattagacctttgttagatgcatagttggtgaatattttctcccactctgtaggttgtctgtttactttgttgatagttttttttgctgtctagaagctctttgtttaattagatcccacttaccaatttttgcttttgttgcaattgcttttggagacttagccaaaaatcctttgccaatccaatgtctagaagagtatttccttgattgtcttttttatagtttgaggtcttaaatttaaatctttgatccattttgggttaatttttgtgtatggtgaaaggtagggagtccaagttcagacttctgcctatggctagccaggcatcccagcaccattattgaatacggagtctcttaaaaagagtaagtgctgtccgggcgcgttggctcatgcctgtaatcctggcactttgggaggccaaggcaggcagatcacttgaggtcaggagtttgagactagcctggccaacatggtgaagccccatctctactaaaaatacaaaaattagccaggtgtggtggcatacacctgtagtcccagctacttgggaggctgaggcaccagaatcacttgaatctgggaggcggaggttgcagtgagctgagattgtgcctctgtactccaccctgggtgactgagcaagactgtctcaaaaaaaaaagaaaatatatgtgtgtgtgtgtgtgtgtatatatatatatacgtatatatatatatatatacacgtatatatatatatatacgtatatatatatatatacgtatatatatatatatatatacacgtatatatatatatatatatttgcagaacaacctctgagctgcctcactctgggcacactgcctatgggatagctgtgctccacaaggagtcctacttctgctgctgctgtatgctgctgcttcaatgaaagttgctatttaacacgaccgacccgccctgaatcgtttcctgggcaaagctaagaaccttcctgggctaagccccaattttggggcctgtctaccctgcatcaattctatatgaattttagaatagtttttttataattctgtgaaaaatgatgttggtagtttgataggaatagtgttgaatctgtaaattgctttgggcagtattatttgcttatttttctgatgaggtattgtttatttttataggttagcaaaagctctttaaatgtcctatttgataaaaattgtgaagatgaaaattttaaacatttatttaaatggcttccaactgctattttacatgaagttacatattctcaaaatagtgtaaaatgctttttgcataaataatttgtgtggattgctttatattaatttcttctaaattaaaacataagtattatgatcttaatacttgaaagtattcttttaagtttttaaaagtatttttttcttcatcacttgtgactatatattacagtacagttttttttaaaccgcaggtgacaactattacaaggtcatgaaatcaatttagtcactcccaactagcattttaaagaaatcaaaaagaacatataaaaacatatcatcttttgcaagggtattatcttaggaaatgtttatttagctattttacaagtatatatgtactgggtcatgatgtaaaatgaaattcgtactgtgagtcacagttaaataaagttttttctgaaagtcattggttggaatggaagaatgtcctgcctgggcttctttcccagctgtatccctttttcagctttgtgaccttgggttgggtatctaacctactcataactcatcttttcatctgtaaagcagggataatattaatatctacctcataaagttgctgtaaagatcaaatgagtaaatccaagcaagtcctaaataaatattagctaatattgttaacataggtattaatacagattcattgttcattatagcaaattttaaaaatacatttaaaaagaatttaacacttcatatcatcacacagagataagcactgaaataatcttttttccgaatacccaagaaatatagaaaatttaatgtaaatttaaaaattctgctggtatcatagaaattcgcgtattcagactcagaagaaaagctttaaagatcaagtatcctgacatgtccacaaatctttgtatttaaagataagcttgagataagtaagctaaactagattcaccaaagacagagttaagcctaagcttctttctagaataaagatgagagaaatgaaatcaggaagggtgcaatgttatcattataaagaagagcttattaccacaacattatgggggcagctgtttcattaattcctaaggctgaatgcaggagcccatctaaacactgcatttgtcataagtcatacagatgaacaccgtactccaaacatggctgaccgaagtacttagtttctttacagtttctccctgggtgatctcatccgttctgtgaccttaaatcctttctagatattgataaactcttaaatttacatccttagctcagacctctcctctgagccctgatttacagatctaacttcttgctttacatcacttcttggaaatctaacatatttaaaacagcttttgccttttttcctcctgatgaaacctgtccttcctcgagtctttcctacctcagtaatgagcaccacccggctgctcgaacctgaaaccgtagagcaccattccttcctctttcttcccaacctgacatccagtccatcggcacctcctgccagttgtgcccccaagattcgcctccagcatgtcctgttggctccatccctacagtcggcacgaggggctggccagccactgggcgcctggagctgtgctaacctgcttctgctctggagtttaacagccaggtaatttgtcctaacagaaatcagacatgtcagtcccctgattaaaagccatgagtgggccaggcacagtggctgacgcctgtaatccctgcactttgggaggcctaggtgggcagatcacaaggtcacgagtttgagaccagcctgggcaacatggtgaaaacccgtctctactaaaaatacaaaaattagccaggtgtggtggcgtgcacctgtaatttcagctacttggggaggccaaggcaggagaattgctttaacccaggagtcagaggttgcagtgagctgagattgcaccattgcactccagcctgggttacagactaagactccatcttggaaaaaaaaaaaaaaaaccgagatgggcggatcacgaggtcaagagattgagaccatcctggccaacataatgaaaccccgtctctactaaaaatacaaaaaaaaaaaaaaaaaaaaaaaaaaaaaacccagctgggcatggtggtgcatgcctgtaatcccagctacttgggaggctgaggcaggagaattcctcgaaccagggagtcggaggttgcagtgagccgagattgcaccactgtactccagtctggcagcaaagtgagactccttcaaacaaacaaacaaaaaaccatgagtgtcttcctttgcacataggataaaatctgtattcccagccgtaaaaggctctgcattatctggccccatctgccactcttcctcttttttgtttttttctcattgttctttgtctcactttggtgatactggccttttctcaagagcttgaactcacccaaaattcctacctttgagactttgtatatactttaccctctccctgagacacatccctctctctcccatccccaaaatttagcttttcatctatcaaatctcaatttatgtacttccttagcgaggctttgcccagccacccagtccaaagtagtggttctcttgttaccctgaacccattattctctttctcagcatcttgttcacttgttttatagtatttgtcacagtttagtaattatgtatttcttgtgtatctttcccaatagactgcgatgagggataaagtcattcctgtttaattcctcattgtatacgaaatgaagtaataagtgaacacatgaataaaaagggacagtcataaattttggaaacagttcaaacttataaacattctcattgccaacttttatattaatatagatcttttggatgatgcaggtacctgttttcagagtgtatcataatattctgtcactagggggcagttacacacctgagattcaacttacctagtttactctcaagacatttttttcttcaatattacctgttttcttcatgtgtctgttttgagggaaattatacaaattggaagatcctgattgtgtttgtataagtttatttgtattcccctcatgcttgagtccctattgatataatgtatttctgactatgctagatcaatctttaatctagaaaattagattttatatttacacataatttccatttctaatatataatattcccacacagccatcctctagatttttgtttgggaaaggggttaggtgtcggggcaggcaattgtattgtcagcatcgtagtagataatacaaaatgatcttaatatgagatgcacacacacaaaatgtcttttcccgttggcaaacactcaagttacatgaaaggaaaggagcagagcagtctgcagagatctgactttctctaggaattaatttcacagctacaacttctgaggatttgcccaagtacttactatcattattcctgttttaaaaaaacaaaacttggttcatgagttcaccaaccttgaaattagtaagcatgctttactattcttcatgtcattttatatgcatatatttgaaattgtgcagattaacagtattgagattcttactctagcaaaatcagaagcattgcagaaaccaaaactgttgtcaggaatcctgtaattttaagctggcaggctgtgtgagttgtaaattttacatttgttactgcagctaaagatggaccattttagctaataaacaaatccctgccatcctttgtcagcaccatgtgaaccatgctgtttatagacatctgaatatctgtatgattttcttgactatggtgatgatattttaaactgtggttataatttaaaatcatttttaaagcctgtatcagtttcagccaagcattaagtgctaatactgaaaaatgtatctgaaaatgagttattttggaatagaggttagatataacaaaatgttaggaagaaagccaaaaacctgtcatgatacatactactgttaatttaggagaaagcactctgaattgttagccagtatgtaaacaaaatcaaagcagtactaaaatgtatatacttttaagttcatgaaaattgttgtataaccaagccaggatggtggctaaaatgctagcaccaggggctaatatcagtgttgctgtaaggtgttcctaaatcaggttattatctgtgctaaggcatgaagtatgttattattattaattttaattgacagatcataattgtatttatggggtaggtacagtgtgatgttttgatacatgtatacaatgtggaatgattaacttaagctaataaacatatccttcacctcacttattttttgtgatgagacatctgaaatttactgttagtaacttttgaaatacacaatacattattattaactgcagtcaccatgctgttgctatagattttttaaaattaattttttataatattttgagacagagtcttactctgtcactcaggctggagtgcagtggcatgatgttggctcactgcagcctccacctcctgggttgaagtgattcttgtgtctcagccttcctaatagctgggattataggtgagcaccaccacacccagctaatttttgtatttttagtaaagatggggtttcaccatgttggccaggctggtctcgaatacctgacctcaaacagtttgcctgcctcggcctcccaaagtactgggattacaggcatgagccactgtgctcggcctgtgctagagatcttaaacacaaattcctcctaactgaaactttgtagcctttgaacagcacatgctcatttcatttccttacccccactcccatctgctggtaactaccgttgtattttctaaggcagtggcccccaacctttttggcactagggactggttttgtggaagacaaattttccatgggcaaggttggggtggggatggatttgggatgattcaagtgcattacatttattgtgcactttatttctattattattacactgtatcatataatgaaataattatacaactcatcataaggtagaatcagtgggaagccctgagtttgttttcctgcaactagatctaggtcccatctggaggtgatgggagacagtaacagatcatcaggcattagattctcataaggagggtgcaccctagatcccccacatgcacagttcacagtagggttctcatcctatgagaatctaatgcagctgctgatctgacagaggtggagctcagacggtaatgtgagcaatggggagcagttgtaaatacagatgaagcttccctcacttgccctctgctcacctgctgtgtggcctgtggctcgggactgctgtaagacatgatgtatttttggttatttgaaaggtggacatagtaatgaaaagaattttacatcaaacatttgttctacttaagtatattttaaaacaaaaatgtttgaggattttagatttttaaactttaggaatccacttttctattttgtttctttgagaaaataattcttgaaatatgagacttgtacaatttccaaaatctttgagaatgcatttctcataaaacatcactttgtgtttacatatatgtgtatatccatgtatatatatacatgtacatacatgtatacacatagacatacacattttccctgttcatttacttttatatagccaaccacttataaagacactaaaagctgacagccaccaatattactctggggctgtgtatataataagttatataacttttgcacctcattccttcatatacatcatatattagtatacccatattgtgatcagctgcaagttttagccttgtagttgttgtttgttacttttatatcctttattcttttatagttttataggttatcttccactgtttattttgtagggttctctgtgtatatgaaaagccaaaaaaaaaaaagctccccattttgtgaatagcttttgtttccataatctattttcaggtcagctgcttgttatttggaatttgttttcccataaaaaataatgttggctaaatttttgagccaacacacagaacctatttcttcacaactgacttaatcaccatttatagcttgttttttgggataaaatgcattgcaccttctaactcttgtaattgtagctgctgctgcttttcttctacttttttaaagagacagggtctcatgccagtcagaatggtgattattaaaaagtcaagaaacaacagatgtggtgaggttacagagaaatatgaacacttttacactgttggtgggaatgaaaattagttcaaccattgtggaagacagtgtggtgattcctccaagatttagaactggaaatacaatttgacccagcaatctcattactgggtatatacccaaaggaatataaatcattctgttataaaaatacgtgcatgtatatgttcattgtagcactattcacaatagcaaagacatagaatcaacccaaatgccaatcaatgataggctggataaagaaaatgtacatatacaccatggaatactgtgcagccgtagaaggaacaagatcatgtcctttgcagggacatggatggagctggaagccattatcctcagcaaactaatgcaggaacagaaaaccaaataccacatgttctcacttacgtataccacattttctttatctctttatcacttgagagatatttgggttgtttccacctcttggcaatggccaattggtttttgacaaaggtgcaaagcaattagtgaagaaagggtattcttttcaacaaatgatgttgaatcaattggatattcatgtgggaaaaaaaaggtgcatcaacctaaacctcacatcttataaaaacatgaatgcaaaattgacttagatctaaatgtagaacttagaactgtaaactcctaaaagaaagaacaagaaaaaatctttaggacctgtgggtaggtaggcagagaattcttagacatgactggaaaagaatttatatataaattcttatatataagaaaaataaattagagttcatcaaaattaaaaacttttgttcttccaaagacactgttaagggactgaaaagccaaactacagactgggagaaaatacttgtaaatcacatatccagtgaaaggacttgtatcccggctatgtaaaaagctctccaaacttaacagtaagaaaacaacacaattaaaaaaatgggcaaaagatatgaacagacacttcaccaaggagaatttagagatggcaaataagctcataaaaagattgaggggcatctggacctgaacttgtatgtgtgaatgagtttgtgttgtttagagtttctcctagaggcacaagagactaatggtgatgtcatactcccaagtggctttgggaaaaaaatgaggcaaagttaaaaaaaaaaaaagatattttacacctttaatttcttggagaaaatgtgaatgaaagtcacaatgtgacaccaccagatacctactagaaacaaaccatgggacattcaaacagtggaatgcttcttagcaatgaaagggagcaaactatagatacatgcaacacattggatgaatctcaaaggcattgtgttgagtgaaagaagccagtttcagtcaaacactgtatgattctatttatatgaacattctggaaaagactaaaccacagtgatagagaacagatcagtggttaccaggggttagggatgaggtagactgtgacaacaaagcaacagcaaaagggaattaaaagttttaggctgaggaagctgctctgtaccctcagtgtggtggtggttacacaagtctatacatacattaaaactcatagaactggccaggtgcggtggctcacgcctgtaacctcagcactttgggaggctgaggcaggcagatcacctgaggtcaggagtttgagaccagcctggacaacatggtgaaaccccgtctctgctaaaaatacaaaaattagccaggcatggtggctcatgcctgtaatctcagctactccaggaggctgaggcaggagaatcacttgaacccgggaggcggaggttgccgtgagccgagatcgcaccattacactccagtccaggcaacaagagtaagactgtctgaaaaaacaaacaaacacaacaaaacaaaaagcctcatagaactgaacactgaaagagacaactagtaattggaggacatagctctcatgaaattggcaatattttatgagataaagaaaacagaaaaggagtaactttttttttttttcttaaatagcctcttgttcttcttacagttttaggctcttttttatacccaaatatttaccttatttttgcaggtttttttttttcctcctaaataccctttttggttaggtgtctccaatattctctaaaattctttaatttttaataaaccgtataggttaaatctcaaaacaaactctagaaaactactcatctgtcttcttatggatttttgaaagattgaaagtttctttttacttttctattttttaaatttttctttgagccctgaccatggcaaggacagaatagttcataagtgctatccatagggtcttggaaacccttggtacagatcgtttctgtagtgatagttgttctaacacagtctgaccgttagctttctctggtttagtgttagctctctcacataggctggtttcattctgagtcttatagtttctattatatttgaacttcttcctagtacaaagaataacaaaggataaattgttggcaagtttttttggcagaaaaggttcgaaaaggaccataaaatagtgagggatcatgaatgtgatgtgttcatttaaagaataaatacgggactagaatgtataatgggaacttagtgtgtaggcaccaaaagttaatctgaaaatattcagcatttttcaaattcttattagaatagtctcttcagcgctgagcttagcaacttaagcaagatgtggaaataattgccaaggttcctgagaagagccatgaaaatttaaataagagaatagaataatacctttaagagaaggttaaaagaactgaagcttcctagggaagagggggagaatttgaagcctatgaacagctagaacaggttggtaactcttcctttcgactggctactggtacaaaaagcaatgtcctttgtttttcaggagggatttgttggcatatgagccttttatctccatttaatgtataagtaaggcaacttacattattgtatggcggtacaataattattagttgcctacagcattgggaaacttaagtcaaagtcataactcatctctaactagtggtatgaccttagtccatttctttaacttctggggcttaattcttaattcctcttatgtttacaaataaagttgaattactctaagagtttctgtaactttggataataataataatgtttaccaacacttacatagtacatactatctgccagtcatggttgccagtatatatattcatatatattaagtatacagtcatgtgtaattcttggaactactatgtgaggttagtatagttactcttgaggaaactgagacatggaaggtaaagtagcccaaggtgacagggttagtaaaaaggaaagctgtggttgaagggaggaagtctggctaacagcccatgcccctaactctgaacttcactatatggtctccctctcccataattctactgttgctttgaattggatttaataaaaatgaagatttagagaaacttcacgatggtgtttttttgtttttgttttgttttgttttgagatggagtctcactctgtcgcccaggctggagtgcagtggggcaatctcggctcactgcatcctctgcttcccaggttcaagtgattcttctgcctcagcctcccgagtagctgggattacaggtgtgcaccactacacccagctagtttttgtatttttagtagagacagggtttcactacgttagccaggctggtctcgaacctcacgtgatccatctgcctcggcctcccgaagtgctgggattacaggtgtgagccaccgtgcccggcctgttttttttttccttacggtaaaatataaataataaatgcttaaattataaggaaggaacaactctagttaaaatgatccattcagaggaaaattaagaaggttactagttgttaacagtggttgtgtatatttcatataatatttagtgaccaaaagagaatataaatcaaactgaagttactctgaggactctatattctttgaaattgtacagtggctttaaaaaaactgtaaaaacaaacccgaatcactgtttttaaagtcagatttaagcagactgtgattctgcacgcctctgttgtcaggtcctcccctgggatactaatgtgttctggatgccatattttaagaaaagcccaactggcctgagggatgggatttagaactgtgttatgtaagaaacagtggaaggacctagtggaaggacctggggatgctcagctgggagaaggaagaatgatctcaaataaatgaaaagctatcctttagaaggattaaactccatgggatagcgttggaccagtaggtgctagttacagagtggcagactttagcttggtagaagccagccgaatgcaaaattggctgacttatgtggtgtcggtttctttgtcaggagattttcaagtgaaggctgagtaataccaggaaagggatgttacagagcagattcgtcctggtttagttggacaaggtggtgttttagttctctcatcacagtgtctggcgtacgatatgtattcagtaaaccactgttaaattaatgacttaaaaaatggaacaggataaatattctgattatttaagaccatagtgacttattttaaaatgacttgattctgtccaaattacaaggagagattgagagggaagaacatttaacttaatttagctataggtttgattgctttctagttcctcttatataccataactttcatcgctattatgtcagtaattactatgtaagtttaaaattgcacaaatttttatatgtatgcatgtctcagcttattaacttgtaagctctctattaggactatattttcataggtattccttcacagcaccaagccagaacctttgtgaaataatataacgtgagggatttcaaactcatgcgtgtgtgtgcatgcgtgtgcatgtggcaggagatggaggcttgttgcccctgttctgttcattttcacctttcatttatgtattctttttttttttttttttttttttgagacagagtcttactctgtcaccccggctagagtgtaacctcagctcactgtaacctccgcctcccgggttcaagtatttcttctgcctcagcttccctagtagctgggactacaagtgtgtgccaccatgcctggctaatttttgtcttaattttagtaaagacgggatttcactatattggccatgctggtcacgaactctgacctcaagtgatctgcctgctttggcctcctaaagtgctgggattacaggtgtgagccactgtgcccggcctcacttatgtattctaatgctgattctaacatttagaagcctttactgaaccaggtatgaatcgtctgatgtagaagggactatgttcagtgtttgttgcttttgtcaggtgcatgtgagggaaccctggcttgttcaacctgtcacctcatctttgaagatcacatatatgagaagttagatgcaatcactgatgaggagaatgacatgctcgatctggcatatggactaacagacaggtaagatttttggactgcttcaattgtaataataatctgggaacatagatgttgtattatgttgtctatgtaagaccagacccataaatgtaatagtgttctaccaggttaaataacagtcacagattttgagtatcagatatgtggcatttctctttgttttcactgttctacagtttagaccttatgaaattttacaaaagtaaaaaaaattaattggaagtataagttctagatcctaacacctcttctttagtctctttttactccaggaactaatatgtatcacaactgaatggaggggttaaatctaatgcttttatatttgataattgaacacaattataatggaaagtttcacctattagaacagaatttttaaagaaacttaatatataatagtaattatgttaaaatgaatagctctttttctaagtgtaccttaaagtaatcagagcttattcttgttattaattaatagttactcttaaaagtggtgagatttacagtagcaagtgacatcaagtgatatcttattttttaaaaaaattatctagtcttttgattggagtcaatgaaggtagctagctgatatactatttcaaggggtaagataatgagggcatattacttaattaaggttggctttgtttaactctagtttggtgaccttaatgacaaataattttttaaaaattaaagatagtaataatagttttatttcatgtgtattatatagctacaattttgttatacacttttaatataaactacctcatttaatcctcacaaacattttcaggtcatttgtatttatttagagaagaagaatcattttgttccttttatagttcatttccctcttggtggatgtgagactgataaccctgggaagagaaactggtgaaatagtatctctttggacaccaaagcagagtggattgtggctactgtctgcctgtcctctcacatcttcagtgccgtgttctctatgagcacctcctttcttccccttaacacagaaactaaatccaatgactgtattagtttggttctgagaattgtgtctcttaataagagagttaaatcatagctaactgcttgctcttttatacagttacaatttgtagatgcctgtaatagataatattctaattgaaaagaaagggaaaagggagagctacagttagatacaaaaggtctataataaatgtaagctagcaagagtattgatgataaaatttccaagttttacagctacacaatagagagcaaggaatagcttttatggtgttttatagctggtattcttaagtacacagcattttagtagaaatactttgtgggaaagagtataatgggtttcacaggtagcatttacaaaacacattgacatatttggaatggaaagaattttgctcaaagctagtaaccacatgtaaacttatttttagggtatcagaaagtttcagaaaaagaaataaggaaattcagccttttagttcatatacttactttaaatactatgtaaatgtttttaatttttaagcaaaaacaccatcgtttctttttttttttgaggcagagtcttgctttgtcacccttgctggagtgcagtgacatgatcttggctcactgcaacctctgcctcccgggttcaagcaattatcctgcctcagcctcccgagtagctgggattacaggtgcctgccaccatgccccgctaatttttgtattttgagtagagacggggtttcaccatgttggccaggctgtctcgaactcctgacctcatgatctgcccaccttggcctcccaaagtgctgggattacaggcgtgagccaccgtgcctggcttcaatgttttattggttgtccttaaccttgattgttgatggatggatggatgatacatggacagcctcattgtttttttcatactggttacctatctcccttttcccattaaaggagcagccatgtcttattttaccattgtatctctaatgccagattcacagtagaggtcaccaactgcttgcggaattaatagttgatggaaagggagattcaggaattacctgtgagtttacattggatgattgtaattgctccctgccaccagtttgcatgggtaatctacacagaggcctcagattccttatatgtaaggtgaggataataatagtacctacctcacagtattgctgtgtggagttaatgaggaaatatatgtgaagctctcagaacagtgcttggtggagaaagcattcattaaatggtagttgttagcattgtaactaccatcatatcgacttatctattgggaacttactgtaatgcctaggcacttaagtattatttctaaccttcagggttaggcagtactatcaccatgttgtaggtggggaaacaaggtttagttatcacggatttgcttaaggctgcacagctagtgggtaacacccctgatttaaatccagctgtgttgggccccaaagcctttagtcttttactatttcaagctgcttctctgagttgaaaaccaaaccctagaactaaagtaaacctaatacccagtatattttcaccatcagggatatgtggcaagagtaactggagaaaataccttccaggtttgcagaagtgtcaaaatgttgtgggactcaaagtgtgaaatcaggggagccttgttgtttgtctccttctctagaagtatgagacaccatctatactggtggatcttggagccagagatctttaaggaggtagaagaagtaggagagtgagaaactagccacagagcgccactgccttattctctagactgagcaggagctttttgttccgtctctttctgtgttcccataacagatttattgttcttctatcaccacacttgtggtaccctgccatgtttcactgataactgtttccatctctgtttcccttactaaagtaaccgttccttgaagaccagcatcatcttgctatctgtgtatgaataccaagagtaaccaacagactctctagagctcactgctgtcttaacgaatttgtccaaattggcttgccactttttctctcttgcagacagagcttaatgcataattgagtattgtgaaggctgtttccaattctacaaataaagaactcttgatagaggggattttttttctattagtaatcagtatttctcatggttaagcacactcctttactccaaaacttcctggtggttcctccttgctcaccagtgaaacacaggccccttaactgatattcacagctgcctgtggctctggccgcttttctggcccatcattccccttgtccttgtttacgctgtgcagcaaccaagctaaaacacccatcttgctttaaatgtgacttgagcttctttgcattgtgttgcctttgcctcacatacttttctcctttatcttgtactaaatagtaaatcctacctatcctccaaagcccattgtggacaacaccttctgtggccagaagtaagggctttcttcttagacctctcagagccatttggctttctccctcggtggcatttgccacagtctcacatgttaactatctgaatgtgtctcatctcatccctttgattgaaagtttactcattaatgctggcattagcaaccaatcctcacagcagtcctgtgaggaattctcctgctcatcttgaagattaggttaggaaactaccatttggtgaggttaagcaagttgcctgtgaacatggtatattaagtgctggattctgcactgctggtctctttggctgtaactctgatgctgtctctttagtgcatcccaatgcccagaaaataagaagtgttcagtaagaaagtgtggagttgatttgctcttcctcattgacatttagtgttgtgcctttaggtgctcaataaatgcttcatgagtacattaataaaaccaagacctgaatatcagatttcatcaaattgaagacatgtcaattgtaagattaacatttctttttatatgccactaaggaagataaaagcactgctaattcaaatatggcacagtcttatcacttaacatattttctgaatattgaaagagttatttagacttatctagacatagatttgaattatatatcactgctaagaaaagaaaatggctgagtgcggtggctcatacctgttatcccaacactttgggaggctgaggcggatagatcacttgagcccaggaggttgagaccagcctaagcaacatggtgaaaccttgtctctacaaaaaatacaaaaattattcaagcatggtggtgcatgcctgtagtccccgctacttaggaggctgaggtgggaggatcaccagggcctgggaggtggaggttaacagtgagctgaaatcatgccagtgcactccagcctgggtgacagagccagaccctgtcttaaaaaaaaaaaaaaaaaaaagaaggaaaataaacacaaaataaaattagtagtaattctgcaaaaaaaaaaggaaattagtcattcttaaaatgacaaatatttattaattccaaatttacaccctgctttctttctgtattcttcttcattttcattttgtaatctttttagactattttgaaaagtaggtaaattcgacatgtgtacttacatactttgcataactaagttgaagagacccctgtatgaatattgtcaccaaatctgtagctgtgacatgaccattacctgacagtgtagcagtgattgtaagattccattgattttaagatgcttcttgatttccagagatggtaaaaatttgagaaaaaatatgctcttataattgatgacttaagtctatgtatttattccagatttcttcttttaaaggctttaaaaagtgtagctttcttttatagtctgtgtggttttaattatctaggaattgattaatcattttcttggccttgctaataacctcagttctccaccattgtgccttctgattgtttccttgcttgtcagctctttgaccaaaaagtagtggtctggtgaaacagttaatagataataggaaccaaaggctaaaatgaagctttggtacaccaagtttattgtattcatatttaccttttgttattctctagttgatagggttggttatatctgttttgacataaaggaaatttaaaaggttaataagttccctgactgctttgggtaagaaaatataaagactatcttaaacaactgcattgccttgtgaatatatatacgtaatactaaaccataccttcccccttttccatacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggacaaaaatatttaattgctcagtaaactgcttaacttcaaagatagttattgaccttataaataaatatttcaaaattttgattcggaagactaagtctggacgtagacattataatgctatcaaagaagtttgatctctgttttgactaaactagaggaaaaatgattggatgtgtttattcttttctaagcagaatggtttaactttgtactctttgaaaaataatgctgatttataaatctctgcctataacagaatggaaaccttatgaatgaattgtgtttctctgtcctgagctggagaagggaatgagcaggctgacacgttgcacagccccaggtggcgccattctctcacgcaaggatggggctgcagggtgagcagcgtgggctgcagtgtgtcagtcccaggagtgagggagtggcaagcaccacagattaccacgtatgtgtggaagacattcgtactcttatctttactataaataaattcataaaagttaacaaaggggtacacagtatggtctttggaaatataataaaacatcaactaacttggactaattgtgaggaagagcagaacaaattagtagaaagaggttataagacaattgagttagcttcatgtgtattattgcagcttgatcatttatataaatatttgtctagtacaatgcttgacatacagcattgtgttatgcccattggggacacagaggtgaacaagacaaggaatgccatcagggaattcaccttttattaggaaaatataaaatatgtatgtatgtgcagataatttgcttgaactaaactgactagttctgctaaataagattttaaactaattcatatgtaaaaagtgattaggaagaacttgaagtatcatttgatgcttaataactattgagtagttttttttttttttttttggtggggggagcgggggacagggtcttactctgtcactcaggccagagtacaatagtatgatctcggctcactgcaacttctgcctcccagtttcaagggattctcgtgcctcagcctcccaggtagctggtactacaggcacggaccaccacgcctggctaatttttgtattttttctagggacagggttttaccacgttgcccaggctggtcttgaacttttgagctcgagtgatccacccacctcagcctcccaaaatgctgggattacagatgtgagccaccgtgcttggccataactattgaatgctttctatgtggagagtgcttgtcttaattttctgttgctataatagaataacacagactgggtaatttataaagaaaagagatttatttggatcatggttctggaggctgggaggtccaagagcatggtaccagcatctgcttggcatctggtgacagctttcttgctgcatcattacatggtggaagggcaagagaatgcgagtgagagcaagagggcaaaatgattatccttttatcaggagcccacttctgacataactaacccacacctgagataacggcattaatccattcatgaggtctctgctcttaaaggagatcacctcttaaaggacccacctttcaatgccattacactggcaatttaatttcaagatgagttttggaggggacattcaaaccatagcagtgctataattttaaagtacttcaaagccaatttattctcttaattagcttcattattcttgtctttgtgtgtggattacctaaactctccttccagagctactttaatgattatattcaaccaaagcactctaaaatttagagtataaattgtcttatatttcaaattagaaaagttcaaatgaagtttaattgtgttattttataaaaccttctaaaattattaaatggaggatataatcta

SEQ ID NO: 8 - DNA, 3299 bp, Homo sapiens
aggcgcggttgtgagtagtaccgggagtggggtgatcccgggctaggggagcgcggcggccgcgatcgggcttagtcggagctccgaagggagtgactaggacacccgggtgggctacttttcttccggtgcttttgctttttttttcctttgggctcgggctgagtgtcgcccactgagcaaagattccctcgtaaaacccagagcgaccctcccgtcaattgttgggctcgggagtgtcgcggtgccccgagcgcgccgggcgcggaggcaaagggagcggagccggccgcggacggggcccggagcttgcctgcctccctcgctcgccccagcgggttcgctcgcgtagagcgcagggcgcgcgcgatgaaggcggtgagcccggtgcgcccctcgggccgcaaggcgccgtcgggctgcggcggcggggagctggcgctgcgctgcctggccgagcacggccacagcctgggtggctccgcagccgcggcggcggcggcggcggcagcgcgctgtaaggcggccgaggcggcggccgacgagccggcgctgtgcctgcagtgcgatatgaacgactgctatagccgcctgcggaggctggtgcccaccatcccgcccaacaagaaagtcagcaaagtggagatcctgcagcacgttatcgactacatcctggacctgcagctggcgctggagacgcacccggccctgctgaggcagccaccaccgcccgcgccgccacaccacccggccgggacctgtccagccgcgccgccgcggaccccgctcactgcgctcaacaccgacccggtgagaggccgggcgccggccgtgggcggacgccgcgggggatgggaggttggtggcgtggtggcgggacgcgggcgctcaccgtcctccgggcaggggcgggccaggaatgacagccccctccccctgctcctccgggctcccccgggccgccagcagccggccgggctcggcgagcgcgggtccgggagaacgcgcagggcgggactcggggctgtgggcgccctgggctgtcaagtcccgcctgagcccggaggggcccccccggctacaggctggggtgggggcgtcggcgcgccagcctgatttccgaggacaatccaggaccgtgtcgagcgcgttgtttgcgcctgctaacctttcccttggtgttcggttgctgttccaggccggcgcggtgaacaagcagggcgacagcattctgtgccgctgagccgcgctgtccaggtgagcgcgcatttcccgtctcgggtggccggtcaccagagacgcccgtccccgagggcttccggggccaggcaccgcggtgttctttgcccccagcgtttctgagagcaaactcccaaggaagtaaatcccctctctccctgccacctaagtagcaagtaaacccgtacttagccttagaactcgaggttcagtctcggtggagacgggtcagcccttgtccccgccgtccccgtgttttttctggtggtcagcgggctcttctgccttccctagttcccgagggagggcaccctcgtgggcatgggagctgccccggtgtcctcccgtgcagtctgtcacccacaaagggggacgcgggcagggcgccggagtgggtcccctctccgggcttcccgagggccgcagctgcctgctcggcgcctggcccggccgcgggcgggtgttgtctgacctggtggtttgttttgggttgttgatcaagcatgtcttgagtttggtcggtggcgccagttagtctgcagcgagaaggttcacacaccccctctattcattcctcttccacaggtgtgcggccgcctgagcccgagccaggagcactagagagggagggggaagagcagaagttagagaaaaaaagccaccggaggaaaggaaaaaacatcggccaacctagaaacgttttcattcgtcattccaagagagagagaggaaagaaaaatacaactttcattctttctttgcacgttcataaacattctacatacgtattctcttttgtctcttcatttataactgctgtgaattgtacatttctgtgttttttggaggtgcagttaaacttttaagcttaagtgtgacaggactgataaatagaagatcaagagtagatccgactttagaagcctactttgtgaccaaggagctcaatttttgttttgaagctttactaatctaccagagcattgtagatattttttttttacatctattgtttaaaatagatgattataacggggcagagaactttcttttctctgcaagaatgttacatattgtatagataaatgagtgacatttcataccatgtatatatagagatgttctataagtgtgagaaagtatatgctttaatagatactgtaattataagatatttttaattaaatatttttttgtaaatattatgtgtgtgtttttttttaatctatgggaatatttcttttggaaaatcatttttcagctcaattacagagctcttgatatcttgaatgtcttttctgtttggcctggctcttaatttgcttttgttttgcccagtatagactcggaagtaacagttatagctagtggtcttgcatgattgcatgagatgtttaatcacaaattaaacttgttctgagtccattcaaatgtgtttttttaaatgtagattgaaatctttgtatttgaagcatacatgttgaaaatacaccttatcagtttttaagtacagggttttatagtgtaatatatacagagtaagtgtttgtttttgtttttcaactgaggtcaaaatggattctgaatgattttgcatatgggatgaggaaatgcttggatccttaaggagtttacgaaatctgctgttttatcaaagtgaaaaaaaattgcttattactcttcattttacactaaagcttaatgtcactaagtttcatgtctgtacagattatttaaatcatggaaatgaaaaaaatgttctctgcttgctaccaaaggacaaactcttggaaatgaacactttctgctttccttcctccaaagaattaataggcaacagtgggagaaaaaaaaggcataatggcaaatccttcaagcagggataaaagtcgatcttcaaacattaacttaagcagaccaaaaattctgatgaccgcatctagattatttttttataaaaatgattttcactatagctatgttacgctaagctactgtccaatctcttgtgatgtgtaacttttacatgtgaatattaaagtagatttctctgtcttgta

SEQ ID NO: 9 - DNA, 53213 bp, Homo sapiens
aataaagcctaggccaaactgcacaaatcaggtagtctctttatgtcattgcttgttctctggttataaatgtagctcacctcatcggaggtgggggcattctgaaccatcttcagtgtagagggctgcttggttctagaatccttttcttgctcaaataaagtttgttaaatttaatttaacttggacttttctttaacagattgacccagtcgacaggatctgaacttccagtgaccatcccaggaacagaaagcaactgtgtaagtgccctccagggcccattgagcccagggatctcttttctgggcctgaattgctgggtgagcctctctctgggattctaacttccacttattttgtgttctgagctctccacgtttatctcagcgacctttgttcctttttctctctctccttttttttttctttcttttttctcctgttttactgaattggatttcacttaagaggccaggcatctgattaagttagagtctgaacagggttcaaaatcaaattggattcaacagttaactagattggatccagttaaaggccttggggtaggtaattttgatcttttcggcatttgaatccagggttttgtgcttgagagagcatttgagaatcatgacagaaacaggacccagtcctacagggaggcctcagtctgactgggtcagacagaactcaactgggctctgtagataggtagagttagcctttctaaaggtaatctaaaattaaagtggccacagtggtgacatttaatttggacagaattgtttacttgtgaggcatattcagaaaaaacagagatcagaaccacccccccaaaatactgggatgtattttttaattggtactgggaggcacgcaaaagactaaattaatccaaattgcctccttaaaagatttctttgcaaaaggcaaacaaaaagcttaagcaacagactaaggacatgaagaaagaggggtgcagtttgaccgaattaaccctgttttgcttcctacatgtttttacctcaagtttctgaatctgttaaccttttggctcaattacctttttgccagaaagagctaggaggaattgttgaaaacctcttacatttaattcctaatagctaaggtatttctgcacaaacaaaacaaaaaaacctccaaaagaaaacaaaacaaaacaaaaaaaaccacacctgattggtctgttacacaattctgcagacaaaaggacaaaccagactgcagagtttatttagaaacattgtggaacattctgagctagaaacgcaacaaggagtatttcctttagggactgaaacagtattaacttatagcctgcaattagacccagtagctaagccataacctaattacttaaaagtaagtagcagtggttgccaaactggtagcgatcttctctgaggtagtttagggaaaaatttttcttgcatgttccacatgctatggaaagcctcttgaattccattctaactcactgtctttcagcaaacagactaacatcttatgaaattcttcttttgtcttctaagcatcatttaaaacactgaaatatacttaatcctcctgctctactacctctaaggacaacagtgaaaactgcccttgtgtgagtgtagcgtcacaagtaacaaccacttgtgttgatttataagattctccattagctaatcgggagttaatgctttgtgttaatgggtcttaagccaaacactagaagaagagaatagcaggcagtgtatgctgttacaatagaaacttttaagctccacatgttttataagactgttgacatttaactgcttctacctcccgacatgccactttcctcaactttagcttttcaaactgacttctgatcacactgcttcatcaaaacgcctgctgggaaagtcaccagtgaccttctgatcactagctgggttgattctttctccatccctgtccaccatataatttgtccttgccgccaggcttgtcacttattctccctcatgcaatccatgtaccagtcaaaactaatacatgctatttcccctggcctgtgcccatgctgtttctctgtgcaggccaccctttactctggtggttcaaattctaccaataccttggctcagctcagtggtaaactaggactcttaacactcagccttttattatcattattcggataaacatcttaattctgttataaaattaactccttgaaagattatagcttattaatctctacatctttcatggtttgtatttaatacactgctgtgcacataattactgtttaatacatatttgagacattgacttcaatttaattgaatttctagacggagcaaattatacccccaaagaacttgagtggatgcttcaaggtcacctgccagggagactttctaaaacgagctgttgtatctgaaaagtgcctctgagcagtgcccctgtagaagaacaaaagcatgtgaggctagacgcacacattttatcatcctcagtccgttctcatggggagcccaggacctctcttcaggggcgagtcttccatggtgttttattgtcaggcagagaacagtgctactgctgctgtagatttctctgactgggctctcctggctgtgacctgttagagcacacgtgcacacagagatgcacacacacacacacacacacacacacacacaatgatcatgtgcacagcacaggatatgagcagaaatacatcacatttctttgatccttattgcagtcaaggcacatgggtgcagctgcaacttgaactttagaatcagggtgtctcgttcctcgaatgagttcatactatctagcattttcattcttgccatctgtcttctacaataggtccctcttgttttccacctcatggaatgaatgttcttttatcatcctgtttattaaaaaacctccaacatatcactacacagaggaaaagcaaggctgttgtggatactcatgtgcttatgctgtgcacctacattcagccccagagccacataaagggctttctaataactgggatggcaattgcagatggccaacattataacactgaggcacagaaaatagtctcacctcttcccagtacttaggagcccagcgtggatagtggagagtgcacattccacatcttggttctgacactttcttgttgtatagtcttgtttcttcaccaatagaatgggtataagattatgtacctcatagatttgttgtgattatttaaacatatagcttcctaatccaatgcctggtccctaatgggtggttccttttaacaagcaaatattctcgactaccccataacatcagagaatagccttgaaacaatgttattgacattttaaaaatcaaacaatatgcaccccatattatagttatagtttcattgcaattacttaaaggagtgaatagacagactcaccttcatatccacttttaatctaactgagaatatctcaagacagtctattgagatggataaagtaagaaacagagacagagcttgttgatgtgtgtgtgagtcatcctccttgtgaggttctgtgtgtgatgaatggctcactggcgccctagggtcactaagaagagagaaaaagatgattagaagaaacggaacattttgcaataaaataaattgctatcaatatctgagcaagtgtatgactagattagccacatgaatgtctgtttcccagggtgagggaaaagctgtgaggcaaggctgttcagtgactggacttatatccaccatcactgattacaacattctcagcaagccgtatttcatctggacacattcagtccctgcccttgctaatgaagattaaacacatcattattttagctttccactcattcactgatgtcccttccagaagtcacctcaccccttaatttcctcctctgtaaagtaaagttcctactgttttctagctaccttcataaagatattcaaggatggctggaaaattcttaagttgtcagaggaaggcaccacaggtcaaatcccattaaaaacacatacagaaaagtattacattttctccatcataatggaccttcaacttaacaaataattcaaaatccggaggagtcctcacgccctggagaacccagctttagagggcggttattgtgatttttccctgtaataataatatttatttatttgtgtagcagtggtagcaagcataagaatagcaagcatcacgtaaggagtcgggaaacccagggttttttctagctctataactctgggcaaacctcagcacacaagcctaagccccatcttttacagaaaaggattggctctataacccttttacctcccaaatgcgaactctcatgcttatatagcactaagaagagtgagagaaaacatacacagtcctcaaagggtttacggtctccccacacctctgggcaacacaatctcagaacaagtatgtacaacgctgtgttgatcttcttatattcctgctgcctggttttattaagttcaatatttctgtatcatattcatgattccttaatttttttgtagagagttttagttttctaaaatatttatttataattgacaaataatagtccacatttatggggtacagtgtgatgttttgatctatgtatacattgtagaaagagtcaatcaaggtaattaacatatctatcaccttattgctttttttttggtgtgatgagaatgttaaaaatctattctttttagcaattatgaaatatacattattattaattatggtcaaaatgcagtgcaaccaatcactaaatctgattcctccagtctaacagagacttcgtaccctttgatcaacatctttccattccccatccctcctcctctcccctagctactggtaatccctctatactttttgtttctatgagatcacattttttctgagtccacaaacaagtaagattatacagtatttgtttccatgactggcttatttcacttagcacagtgttctccagctccatctatgttgtcacaaatgacaaaagttccttctttttcaaggctatatagtattccattgtgtaatatagtatgttttctttatccatactatcattgatgaccacttatgttgcttccatatcttggctattgtgaataatgctgaaatgaacatgggagtacagacatctcttcaacataccaacttcaattcctttaaatatatatccagagtgcaattcctgggtcatatggtaattatatttttagtttttttgaggaaacttcatactttttcccaaaatgactgtactaatttatgttcccaacagcatacaagggtttcctattctccagatccttgctaacacttatcattcctcttttggataatagctattttaacagatgtaaggcaatatctcattgtgttttaaatttacatttccctgatgattaaagattctgagcatttttcatgtatctgttagccattcctttctgttattttgagaaatgcctgttcagatcctttgcccatttttaatcatgttgtttgttttcttgctcttgagttgtttgagttccttatatattttgaatattagttgcttatcagatgtatggcttgtgaatattttctccccatccgtgggtggtctgttacttctgttaattgtttcttttgccgtgcagaagtttctgagttgaatgtgatcccaatttgtccacttttgctcttgtggcctgtgcttttggagtcctgtccaagaaatcttgcccacaccaatgtcatggagagtatcctcaatttgattttcacagtattgaacattaactgtgtagtgtcacagtttcaggtcttacgtttaagtattttattcattttgagttgacttctgcatatgagtgtgagataagtatatccacatgtagaagaatgccatttattaaaatgactgttttttcccaatttgtgttcctggcacatttgtcaaatatcaattggccataaacacttcgggttatttctgggcattctattgtgtttcattggttgaggcgtctgtttttatgccagtgccatgctgtttttttgttttgttttgtttttacaatacattcataatatttttgaaatcaggaaatgtgatgccttctactttgttctttttgctcaagattgttttggctattcagggtctttgtggttccatatgcatgttaggattttttttctatttttataaaaaaataacattgaaattttaaaaggagttgtattgagtctgtaaatcattgctttgggtattatggatagtttaacaattctaattttttcaatccataaacacagaatatctttccatttattgtgtcatcttcaatttctttaatcaatgttttatagcttttagtgtagagatctttcacctccttggttaaatttactcttaagtattttttctgatgctattgtgaatgagattatttttaaaatttcttttccagatagtttgttattagtgtacagaaacactactgatttttgcatgttgattttataacttgcatcttattgaattgatcacttttaacagtttttttggtgaaatctttagggttttgtatatgtaagattatatcaacagacagtctcatttattccttcctcatctgtctcttcccaatgaaaaagaattaacgctcagaattacagtatcttttcttgttccctcttttacctatcccactatattccaagaatagtaaatattaaaagacattgaataggttttggaatatacaatgaattaacttagatttgatctttgatattaacccacaagttttatttatatagttatatgagcattagtcagacttatcctctaagtcctaaaattttgtgtttaaaaattgtaaaatttacaaacaattgcttctgacgtaagaatgggaaaattgctttatttttataagtcctgaattcccagcttatattcatttggtgtcactgtcattacccataaatactactaggtattacatgaaattccattgtatacaataatgggttagtgtttttacctcattttagaaatgaggatatatgtgttaatgataaatgcagtgggaggaaagacattcgtatcccactgtcctaaagccaaacaataatgtttatgttgacctttcagatttgctcatcattttccttagctggaatcagaagaatagaagtcttagttttcagttttagattacgcaggttgcaactttattaacatgtgtatcgttgtccaggagaatccaaaaggcagcttagaagacggatgtttctaattatctgagtgactttgggcaccttttatttaatgtagccttaaggacccttccagttttgaggttatcttagcttttgattttcacagtattgaacacatgggattaagattcagtgagaaacagctgagtcagctattaactttctctcttcttacatcctccctggattttctaacaaatggtgcaattaatctaacgtagctaaaaggcattattaggtcacatgattggagtcatgggacagagggagggagatgggaaatggcaagtgctagctgacactgcagggaagaaataacaccactagaggcaaacttaagagcaggagatgcaagaactcacactgtatgtttctaggaacctctgtttagcaactgttttgcatatttttctggatttgtagctacttgacagaaaataatcagtggtgacttcttagacagcattccttctggtcaagctggtcttcagaatattaagctactgaacataagtcaaaagagaataaaagtttagtgtggattttcttgtatattaaaatgtgtggctttgatatactattttatttctgggctgagttagaatcaacttgataacaaaacagacatctcttcactcacagaacctggattgaggttctatttttgggtcttcactggaagttttgctactttggccaggatgtgtagacagcagagaattacagtgctcagtgagatgtgagctatagctgaagagctcatgaatcaagttttcctagtgaaaattatcactgttctttccatttaagtcacagatgaatagaattgcaaggctttcagcaaatccataatgtggacaattgagtcatattcctttgagagaggaaggagtagataaaatatcaggactgtaaccagtttccctaacagatgagtgagtgttaggagaaggaatgccgggttttgaacagagacttctatgggctccattcagtttcctctctgttcaaattctagagtttagctgacaagcttttcaagtctaataccacttactcctctagatttgtcttttcaccttacgcttcaacctcactaaacaacaagtgttctcctccaaacactacaaatccttctctatagaatacctttcctcaacagtttcaacttgtccttcttgttcctgcgtgcctttaattagtcaacatttatccctctatattccactgtatgcccggccttctctcttgtcctcttcctcactctgtcctggccaatttgttcttacatctctccatctactgcacagtatttgcctgatatttggtgtctgttccttgcctaaaacattgggaaaatctccatggtggggattgtgtcttagtcgtttggcacatccagttccaggacactcttcatatcctcaatgtggtaatactacataatcattcacttgataatagcagcagataaggtgaaaaggtagatagggaagagagagaatgaaataactgattttagggaattggtctaaggtagaattgaaattttggagcattttctatggccactcaaattagtagcatcctcttgagaaccttggttttgaagcaccagcctggaagtggcatgcatcaccttcacttttttccacttgtctcagtgtcagctggaagctttttgatgtgctacagcaaaaggctaagaaatggcgtattgaaatgagcacagaaagaagggcagaactgattttggtgcatgattagcagtccctgctggagtctgcagaccccaggaaaatcgtacatgtgttctcaaatgtctataagggatcaagtttcagaggcgtgggagacagaatcagagcataaagcatacttctttagtcaatcatagtactagggccctagggatagatctacacatgtgctatcacaaaccaaatcaaagcaaatatttattttgcactcatatgcatggcattgtgtttagcctcatgaaagacacacagaaacacaaggaaggcactgtttctgcctgcctctaatgatttgcagtgtagaaagattaaatcttaagcaactttacaagatatacaaagaataatagaggagatgtcataaggcaacaataactaatggcccaaattacagactaggcagagccggggcatagtaagaagtcagaggagggagtatgctatgcagtaggggtcaggtaagatttaaagaaaagtactgaggcatgaaagacaaggtgtgtagataagcaaggaaggagaattgggggagctagagggaactcattgaaaccccaaaaatcattgaggaccaccagttgcaaggttctggaccaagcctgggtgggcttgatgagtggacttgattctgacatcagggtggtgttgagttaggaaaattagtgctagagttggatttcacacttagatgaagggaaaatgaattttgtcaagggggatgctatttgactagggtctgaggggttgagaaatggtttttgcagtccaaaagtacagatggagcaaatgcaagcaggtatgaagcctatagtggatttgggaaggagaaacaaagaaacaaagatctattgagcacctgctctgctccagtattttgttgaggatttttgaatctatgttcattaggaatgtttgcctgtaattttcttttcttgtagtgtccttatttggctttgatactagaataatgctggcctcataaaatgagtttgagttctattgcacaatatggtgacaatttatattaagatatgatatagtacaaaatatctaaaacagaggcttttgaatgttctcaccataaagaaataataagtgcatgaggtaatggtaacactaaatacccttatttggtcattatacaacatatatatattaaaacatcaagttatacctcataaatatatgtaattataatgtatcagtttttaaaaatgaggtggctgggaatagtggatttatttctggattctttgttctgctccattagtctgtgtgtctgttcttatgccaataccatgctgctttggttgctatagctttatagtataatttgagacagctaatgtgatgcttctagttatattctttttggtctggattgctttagctattcagggtcttttgtagttctatacacattttagaattttttttctatttctgtgaagtatgtcattggtattttgataggaatgcattgaatctgtacttactttgagtagtatggccattttaagaatattaatttttccaatccattagcatgggatatctttccattttttgggtcctcttcagtttccttcatcaatgttttatattttccttgtggagatttttcatttctttgattaaacttatgcctaaaaatttaaaaagtagctattcagtaggattcaatgggattgctttctcaatttctaagatttttttgcaattggctattggctgagtacagattcaacgcaatccctatcaaaataaccatgacattcttcacagaaatagaaaaaaaatagagatgctatggatttttaaatgttgattttgcatcttgcaacttgagtgaatttatcaatttgaacagttttttgtggagtccttacgtttttctaaatataacaccatgtcatctgtaaacagggataatctgacttctttctttccagttgagatgccctttatttctttctcttgtctgattactctggctacaacttctagtactattaatatgtataaaagtggtaaaagtggtgaaagtgggcatacttgtcttgttccagatcttagggcataggctttaatttttctccatttggtatgatgttagctgcgggttgtcatatatagcctttattgttgtgagatattttccttccatatccagtttgttgagacatttcaccatgaagggacgttgtattttatgaaatgtttccgcttcagtcaggtagtggtgaagcaggccaggacttgttttcctccagttggggcagtggattctcctctgtcccagggaaggtctaaattctccctctctaggtttggaatcaggcactgtgggggctctgcctgtgctgtgttgcaccgtggcaggcctgactctaaattccaatacaaattcccatacccacttcccattcccttccccaagcaggaattgtctctctcctctctatggtgcctggcattgaggagaggtggttttggcaatgagtgattatccttcttaccttcttcagtgtgtatctcttcttgttattatgctaaaaccaggtactgtgatagctcacctgatttctttagctcttttgaaggtgtcttcttgcaaggatagttgttccatttgatgttcctgtggggggtgattgacagaaggcctgttcagctattttgctccccatatttgaaactcagcatttctttaatattccaatgtatcagtctttttttataattaatgccttttatgttttatacatactattagtgcattttgtgtacaaattttcttatagcccaaggtcatgaagattttctgcactgatgtttattggaagctttattgttttaccttttacttttaggtctacaatccacctaggattgatttttgcttatggtgtgagctatagattgcttcgtttttaaaaagaaactcttttcactgctttgcagtgtcatatttgtcatgaatttggtgtccacatgagtgggtcatttctgagctctctattatttccttagcctatttttcaatcttgatttctagaactaactaagtcatgttttctagcagagtaattctccccacattgttcttctctaagactgtctcactatttttgactatttgcattttaatattcatgttaaaattaactcatcaattttcactcaaaaagtgttgggatttagatggggatttcattgaacatactgataaacttaggaataaattacatgttttcattaatttctatctaatcttcatttatttaggactttaaaaatgtctctaaataatgtctaatcattttctgcataaagatcttatgcacctattattagatttattactatttatttgaagttgtttatgctattataaagtctgttttaaattaatttttgtcttagtctattttgtgctgctataacagaataacacagatggagtaatttataaacagaaatgtattggctcatagttctgaggactgggaagactaaggtcaatgcaccaaccagaggggagaagaacgctgactcctcatgtggtggaaggtgaaaaggaccaagagagagcccactcttgaaagccctttttacgattgcattaatccattcataagtgctctgccatcatgatgtaaacacctcccatcaagccccacctctcaatactgtttgcattgcaaatttcaacatcagttggggaaggggacaaacattcaaaccattttaaaccacagcattctggctgtggtcccccaaaactcacgtcctcgcatataaaatacattaattctttctcaatagtcccggtaagtccaaagtccagagtcccatctaaatggaagaaaatttgcagaattaggagtttgtaggcagatattcagaagaagccggcagaagaagttccttacccatgtagtgtcttaaaggccattagagataaatagccctgaggagtcagaagaatcttcctagattaatggttcatcattttctgtgttcccttacagaacggaagatatgggtgagactgaagcatggttcatcctgagacgaatcccctcccacaataaacctatgaaatcaaactatttatttatatgtttccagaatacagtggtgggacaggcacaggatagacattcctattctaaaagggaggaataggcaagaagaaaggggtagcaggtttcaagtcccaaagccaatagggccttacatcttaaggcttggaaaaaaatcttgactctatggcctgcctttcagacacacttgggttgacctcccaaggcctcagacaaccctgcccctatgactttgctgggttcagcccacacagcatctctcatgagttggagtctcatgcctgtgctctcccaggctggcagtgtatactagtggctctatgctttcagggtcccggggcggggtggtgggggggtccctgttcccattgcttcactaggcattaccttgatgaagactctctgtggtggccccacccctgtgacaagtctctgcctgggccccatgacttgccataacatcctttgaagtcttgttgaagaaattcatgcctcctcagctctggcactatgtgagcctgcagaattagaaccacatagatgcctcgaaggtttacaatctgccttctggaagactaggtgtggccaaggagagttgcattagaatgcatggatcagagtcctgagacagccctgatagagagcagcccacggagggcgccctgggcccatcatccaaaacccttctgcccacaaagccctaaagctctgggcctgtgattagaggggcagccttgaagacctccaaaatgcctttgggatcattctcccactttcttgatgagtaacacttggctttcttttatccatttaatctacaaattactggaattaatcagtgtaattagcaaggttgttgaatatgaggtcaatacataataatcaagaataacaataattaacagcattttaagtaatgctattatttgaatgtttgtcccttcccaaattcatgttgaaacaatctcccatccaacagtagtgggaggcagggcctaacaagaggtgtttaggtcatgaggcctctccagtctatgaatggattaatgctgttgcaaacagagctttcaagagtgggctttctctcttggcccttccactttctgccatatgtggatcctgcattctacttccctctagaacatttcaccagtttttgcgtgcactcatttttctaatgcatgcttgtgcaaaattctatgacattttatcaaatgtacagtgatatttgactagtaagcttatctcaaattcctggaataaattcaacttggttgtgggctgctatcttttttagttgttgctggcaaatctaaacattggttaaacaaatgtttaaatgttatttttttcaggtttcaggagtgcttgtttcggtttcaggagtgcttgtttcagtttcaggagtgattgttctgtaatttttccttcgggaatgtccgtatcaagtttgtgtaccgacattagattaacttcataaaagaagttaggggaagagttcttattttttctattctcttgaaaagtttataaaagttttgtaaatatttagtacaattcgccagcaaagccatctaggccggatgttctgtttgtgtgaattttttaaatttatagattccattcctttaatagtttcaggattatttagaatttctatttttcttgtgacagttttatgcattatattttttcagaaatgtgttaagtttaccaaaattttcaaacttattgccataatactggtcataatgtggtgtaattttgttttttactgcttctgagtctgtgacaatattccccttttcaatcctatattgttggtctttgtgcgttccctctctgtatctgtcttttggtcagtctcatcagggtttatccatattactagtctttaaaaacaaaacaaatcttaatgttgttgttttctttttcataatttccactatctttattcttttcattcattcttcttttaaaattccttgggtttaattcacaactttcttattcatttcttgagctagatattttagatctttatttttcaccctttctacttttcttacgtatgcttaaaattcatataaatgcatataaattattcctttaagtattgcttcggctatgtccccaaaatttgatatgttacattttgttatactttcaaaatattttctatttttatcatggtttcttctttgatccttggcttagttataagtgtcctcctaaatttacaaatatttagaaagtttaagtcctctttttgttattggtttctagtttaattgcgttgtagtcaaagcacacagtacgtatgatttcaaccctttggaactggttaacacttgcgttacacgtttgggaacatttgtattttaatgtttttgggtgaagttttctacatatgttcatgagagtcaagtttgttagccatgttttaaaaaaaatctattcatactgattttttgtgctttgattttattagctagtagaagataggcattgaaatttcccattatgattataggtttgtctacttcttcccgtagttctttttcatttatcttgatgttttactgtatgattgtacatctagaattttataattccaaatgaattaatgtcattatgaagtgctcctcttaattctcataatgcttttatctcagtgactagcttgcatgatactggtgtaggtacaccatctttctttttttcttgttgttgttaatgttttcactcttttcctttcaagcctcctgttttcttgtgtttaatatcgctacacatatgtaagtagcatatagttgtttttgaaaaatctaatttggcaatatttattttgtaaatgctttaacacaattgctgatattttaggtttatacctatcgtcttattgtatttttattttcccatatgtacttgattcatttttgcttttagaacagttgaatatcttttattattccttttcttttctccattgtttggaagtttttcctgtcttatcatccttccagtgattgctttacagatcgcaacatgccccttcccttaacaaagctgaaaattaattgctaaaaattgacaaatgggaactaattaatctaaagagctttcgcacagcaaaagaaactatcaatagtgtaaacagacaacctacagaatgagagaaaatatttgcaaggagagcagaagaaactcgaggagctaaaagtgaaagctgcagggaaggggcccctggctagaggtcaaattaagaaatctggcaaaaagtaagctgttccttgtgcctgaggagttggtgactcttgatttcatttgtacttaaacacctgtattccccgccataacatcttttgccacctatagctggaatgaagtgttgtctcggaactggtgtaaatataagaataaacttttgtactaaaaaaaccacaatgatataccatctgacaccggtcactgtggttattattaaaacattaaaaaataacacatgctggcgaggctgtggagaaaaggaaacacttatacactgctggtaggagtgtaaatcagttcagccactgtggaaaacagtgtggtgcttccttaaagacctaaaacagcatttccattgacccagcaatcccattactgggtatatacccaaaggaatataaattgctctaccataaagacacatgcatatgtatgttcattgcagcactattcacaatagcaaagacatggaattaacctaaatgcccatcaatggcggactggcttttaaaaatgtgtatgtggtacatatacaccctggaatactacgcagccataaaaaagaataagatcatgtcctctgcagcaacgtggatgcaactggagaccattatccttagcaaactaatgcaggaacagaaaaccaaatacagctgttcccacttataagtgggaattaaatgatgagaacacatggacacgaagaagggaataacacacactggggcctacttgagggtggagggtgggagaaaaaaacgggataaggaaaaatacctgtagggtactatgcatattacccgggtgatgaaataatctgtacaccaaacccgtgtgacatgagtttacctatataacaaacctgcgcatatgccccggaacctaaaagtttaacagatcctgaaagaaactgctacttttaatccatttattccctctcaatttgtatgctattatcttgtatcttaaacacacacacacacacacacacacacacacacacacacacacacttttatgccacatgagacagcactattgttttgtggctccatttttataaagctatgttgtcttcttcaaaaaagttaaaattcatctttacataatacagactagatctagaaattaatatacttttactctttgtacctgagcaaaacagaacactagaaataaaggacgctaaatagcataatagaaagtctgtatgtatgtgatttcacaagtaaacaattagacacatccctgaaaacactgtaactgtaagaaagcaacattttttcttctgatgtctgcccaagcccaccttccggaatccattcattaaacagctttatgtcaactttgacttcctccagttatctctgacactaatgacgaaatttttctttgacttttatcaaggtaaaattcattttaagaaatgaccactgatttgtttaagatattccagcatgggggaggagggcaaaatatacatttataaatgaataagtcttagttataactttattagcttttgactcaagtttaagtcaaaaaaagttgattttatcaacttttattaaaattgggaaataggcatgtggcatttgattatacatatctttatttttgtgtatgtttgaatttttctttaatataaagtaaaaaatagtggcttttttagttttttagcttttttaaatgaaatttaattttttaattgatatgtaatagatatacctacttttagaaaaacatcaggccgggcgtggtggctcatacctgtaatctcagcacctgggaggctgaggcgggtggatcatgaggttaggagttcaagaccagcctggccaacatgatgaaaccccgtctctactaaaactacaaaaattagccaggtgtggtggtgaacacctataaccccagctactcaggaggctgaggcaggagaatcacttgaacccgagaggtggagactgcagtgagcccagattgtcccactgcactccagcctgggtgacagagagagactccgactcaaaaaaaaaaaaaaaaaagaaagaaagaaagaaagaaaatcagtgtattttttgcctatcacatctgcagagtatttgtcccttacttagagatctcagtaagaaatatttattacaacacataaaatgcattattcactcatcaaagttgtcagataatttgctacagtttttttccttgggtagcattaggggttccttgaggatttcaaacttgaaaaacacatgttttatggcagcaattttattcactttattattttttccaacttttccctcccttcctctcataataacgtttattgatcaggcactgtgctagctactttatgtttgtaatctgctttaatcattcctgcaaggtagcaggtatcagcacctctcatttggagagtagtacgagatgggaaaagagagcaatactctgggggaggcatatcagataacagtgtagtttgaaaaagcacgtgtaataatataataaaaacggtcacacaacatagagttgatcaaatattcactactagtaggaatatactaaagacatatttttctaccccagacattagaatctcaaggggagtgggaagtgattatttgaaaagttgatcagtttttataggtagaaggcttttgtttatttactttgcgatgtggttgtttcttgccttttctctccgaattcccttgcagtatgggctggttacactgtgttccacctgcatgatgactgtgaagcttagaagtcacagagttctgtggttgttgtttaggatcactgttatgtagtattgacatttgattattattttgtgacaagagtctcactctgttacccaggctggagtgcaatggcatgatcttggatcactacagcctccacctcctgggttcaagcgattctcctgcctcagcctcctgagtagctgggactacatgcacgtgccaccacacctggctaatttttgtatttatagtagagatcggttttcaccatgttcgccaggctggtctcgaactcctgaccacaagggatctgtccaccttggcctcccaaagtgctgggattacaggtgtgagccaccacacccagcctgctattgacattttatattctaatatatgtgttttaatttaattcagctcttataagaacctgatgagtgagatgatcttaatcccattatacatagaacaaaatggagatgctagaggtaacttgcccacatttactatccaggctactgttgtaagtttaattaagtgcttcagaactttttctgttcactcctgtgtgaaagtgtgtgtccttgggctgtatgtctcatgcagagcataatttcagaggaggcggtattcactgatgaagtcctgggcagctttgaacacagcctagagtatttaaattgtggccacacacagtgtgacatcactctagtgatcatctttgaactgaatgagaagagtgtttcctctttaccctacatgcattcattttcatgtttattagcccaggcgaaaaactttcctgaggactgactctgaaaaccgatttaatacttctttcagctgctttcctctttcagctgtggacctagaagccatgagcagctgctctccaggacgtggtggtgatacccactgctgaaatagcatgtggagcactgatgcaggaggccagttttatgccttctgtcttggacaaagaaagcaagctggccctgacatccagttgtcatactttaagaataaaaaataaataagtaaatatatagataggtaataaacagggccaggcatggtgactcatgcctgtaatcccagcgctttgggaggccgaggtgggtggataacctgagatcaggagttccagaccagcctggccaacacagtgaaaccccatctctactaaaaatacaaaaattagctgggtgtggtggcacatgcctgtaatcccagctacacgggaggctgaggcaggagaatctcttgaaccaggaggcagagtctgcagtgagctgagatcacaccactgtgcttctgctgagtgacagagcaagactgtccaaaaaaaaaagaaaaaaaagaaaaaaaagataagcaataaatatactgataccctgtataataatacatattttagaactatggatcaaatattaaagtcttccacattcatacaatatccttaattaagatcaggctcaagtgagcatttctgacctgtatgtaattaaatgctgactgaattgaatatgtctacagtatgagaagaacacaacaaaataataggttttatagactgcctttgattttcacttagtggtgtttttagtttaataaaacctctgaagttttttataaaaacttttatgtatacaagcctgtttctttttctaagatttttgcatttcacaagagaaaattccattcttaacattaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagatatagatcgatggaacagaacagagccctcagaaataacgccgcatatctacaactatctgatctttgacaaacctgagaaaaagcaatggggaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaagacctaggcattaccatttaggacataggcatgggcaaggacttcatgtctaaaacacaaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaacagacacatgaaaaaatgctcatcatcactggccatcacagaaatgcaaatcaaaaccacaatgagataccatctcacaccagttagaatggcgatcattaaaaagtcaggaaactacaggtgctggagcggatggggagaaataggaacacttttccactgttggtgggactgtcaactagttcaaccattgtggaagtcagtgtggcgattcctcagggatctagaactacaaataccatgtgacccagccatcccattactgggtatatacccaatggactataaatcatgctgctataaagacacatgcacacctatgtttattgcggcactatgcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacactgcatgttctcacccatagatgggaattgaacaacgagaacacatggacacaggaaggggaacatcacactctggggactgttgtggggtgggggaaggggggagggatagcattaggagatatacctaatgctaaatgatgagttaatgggtgcagcacaccagcatggcacatgtatacatatgtaactaacctgcacattgtgcacatgtaccctaaaacttaaagtataataataataaaaaataaaataaaataaacaacaacaacaacaaaagattttccagatgttaagatctaatgaattagaatttttttttttttttttttttttttttgagacagggtctctcagtctgttgcccaggttggagtgcagtgatgcaatcacggctcactgtagccttgacctcctgggctcaagcaatcctccacctcagccactcaagtaggtagcaccacaggtgtgtgccaccacacctggctaatttttaaaaatttttttgtagagatggggtttccctgtgttggtcaagctggtctccaactcctgggctcaagtgatgctcacacctcgacctcctgtagctacttgggaggcaaggcaggaagactgcttgagcctgggaggcaggggttgcagtgagctgagatcgtaccactgcactccaacctgggtgagagagtgagactctgtctaaaaaaaaaaatttatatatatatgtatataatctgatatatatatatataatatatatatatatatcacatacttttcaaaaacatacagaaccaggtccttaaagagacagtccttctatcatgtaattcctgtgaaaaacgggatattgtaataatgctacctgtaaacctgctttttttttttttttttttttttcgagatggactttcactcttggggtcacccaggctggagtgcaatggtacgatctcagctcactacaacctccgcctcctgggttcaagcgattctcctgccttagtctcctgagtagctgggatacaggtgcctgccaccacacccagctaatttttgtatttttagtagagacagggtttcatcatgttggccgagctggtcttgaactcctgacctcaggtgatccatctgcctcggcctcccaaagtgctgggattacaggcatgagccaccacacccggcctaaacctgctatttttaaaaacaaaaatatacacggttgcatgcatctccatcacgtcctctttcaaacctgtggatcctgtggcttaagtagacatcctaactgttactggcttgatgtgtagccccctggagccagatccttactggggtatgattagggctgaatggaattgggacaaccggatggccagcctgctttgtgttcactggaggtgggggagtgccgacccactggtgtggcacagcagagcaaggctgaggcttatcacaaaacgtgattattaaccagtagtgcacggagctgcactgggcattttctttgaagagtgactactttagtgatgtgtctgtaggggagagggtgaggtggcatagcctcagtgatttaaatctttttagtcacgtatatgatctctgcctatgatgacaattaggatttctcagattttcttcttactctgatgtttagcaccaggaccaagtcgtatctgttgagtccacttgtgatggtggaggtctgttatctccatatagagagtttaatggccctgtagacacaatataaagcatggcccttgagcaggagacttaaggttggctgggcacggtggctcacacctgtaatcccagtactttgggaggctgaggcaggtgatcacttgaggtcaggggtttgagaccagcctggccaacatggtaaaactctgtctctactaaaaatacaaaaattagccgggcatggtggcaggtacctgcaatcccagctacttgggaggctgaggcaggagaatcgcttgaaccctgggggtggaggttgaagtaagttgagagacgccactgcactccagcctgggcaacagagtgagactctgtcttaaaaaaaaaaaaaaaagaatattcaggcagaggcagcaggaatgtgtatgtttctcttgttggattcatcgtcttctctcccagctaaggagctgcatgggagtaattgtgctggtttctgttagatggatacctgcatgttctcagatggagcagagatcagaccctcttctcactaatacgtcatccaaattgctagcagtttcagcagtggtccagaaaatggtcaaatctctgtttgatgagtaaggtcaaggagtttccccttggagttacaggggatcatctcaagaccaggagcctctgcacaggagacacaagcatcccgtgaacatggaggacaacacatggcttcaaatcatgcttcgccatgtatgcagaatctctctaagatttctgtttcaaattcgcagatcaccacgctagtccctaagggcatagctacttctggttagtgagagtgaaggaggtagaggtcaaaagcatagattgcttccagaactgcagtccctaaacagaatattcaaatagggctaaggagcctcattctaaagtcagaaagtgactgtaatttacctggtaattagatatgctcagaagtaacttctgacttttcccatcaatttctaggctcccttaacacctgtaatagctggacaaaggaagaaagtcgtgctgcccttggtggaagtttggacccatccccagagaactgtatacgcttcctgctttcaaataatatgtgtaatcctatggggtctgactggcagacttacttttttttctgattcaaaatgccattcctgtatattattaaaatttggaaagtacataaagatataaagaaattttaaagcaccacacgatcccactactaagagttagggtctaaaatagtgtggtctgtcctcctgagcttttttctaggtgtaaatgagctagcatcagctgcactcagagcccataaacccaggttcactttcaaagtcgtgttcaggaacttctccttgcattctacctgatggggatcagatcttttcgacctaccagttatacacacacacacataaatacacacactcagaagttcttgatgttagattaaaaaaaaaaagaccctgatggcttgaagaattgacataccacaaaaatgtacgatgcacttttatggggtacacagaggtgaagtttgtcttataaatagatggtggatccaaggattaatttacagaaaaaaagctttggaaacttttaataaatatacagcaatttcaaaacattacactttatacaacttttatttttttttttaatagagacaaggtctcactatgttgcccaggctggtctcaaactcctgatctcaagtgatcctcctgcctcggacctccaaagtgctaggattgcaggcgtgagccaccacacccagccaacttttacaacttttaaagagagaaattacgaaatgtaattaaagttctgaataaatgccccaagaataatgagatcctgaagtctctttcacctgagccttcaaaggcatgaagcacaatgacaaaagtagggatgaacatatgaggaaaaaagaaaaaaaaaataagttgtgcctctataaaagccacccaccaaacacaggacaaacatgaaagtagatgatgacagactaacacttcagtacaaaaagagatgctttataggaccttaaactatctccactcaatatttttcatgaggatgctgtacttattaccgatacatctgactttgttacttctttgcatttctgctgcatttcaatctgagaaagtcataaattcttgaagctcttagtattttttctctcccttctgggaaggttagaaagatgacaatgataaatgcataaataaccagcagggagggaaggtgcatcattacatttagaaacacctgactgtcctagctttttattattttaagaaagaggaaggttattaaaggatattttagaactacagaaaaatcaataataataaaaactagtatctgtatgtgatgttagagttcacaagcactatcatcaatttccatttaattcttgtattagtccgttctcacactgctataaagagtattacccaagagtgggaaattatgaaggaaagaggtttcgttgactcacagctctgcaggcgttaacgggaagcatggctaagaggtctcaggaaacttaaaaccacggcggaaggcaaaagggaagcaggcacctttcacccgatggttttaaagccatcagctctcatgagaactaactcactattatgagaacagcatggggaaaccacctccaagatccatgaaccacccccaggatccaatcacctcctacctggtccctccactgacatgtggagattacagtttgagatgagattgcgttggggactcggtcccaaaccatatcaattcttaagcaattttgtgacacagattttttttattatccccactttataatttactaaactcattgaagtacataaagacatcatacagccatcgggggataactcagtaggcttcttggtctaattctgtgatcctcaaccaggagtgatctctccacctctagcagacatcggcagtgtctggagacatttttggttgttaccactaggtagtgctattggcatctagtgggtgagaccagggatactgctaaacaatgcacacgacagcccgtcacaacaaaggctcatccagtcggagtgtcagtagtgttgagattcagaaacactggtatgttctacactttcattagggtcctgatgaaactcttaaaacttggtgtggcggtttgtctaaacagcatcctttctctcattgttcttgctgtcagaacctcattttattcagggaagggcaccctaatctcagtttaggagtaaatattggttagactagattaatcatggtaatcccatttcctgtcagcagttgattatcagggatgggcatgtgacctggttctgaccaataagacacgaagggggatctgctagagggatgggttctgggaagtatgtttatactttttttttttttttgagatgttgaaattatttttaggaaggctaagaactaaaatcatttatatatgtatgatgagacaacaagggatgccaaaacaatttagaaagaatatacttactaaaattgctagcaaaggcaaaaaataaattaaaaagtaaacccaaaacaaattttagagataccatgccttatagaacttctagaattgatacattttaaatttatggaccatttccttgaattgaaattaacagcagagactttccaatctaggcaaaaaaaaatctgcttttcttcctccagaatcagagaaatcaatgaagtgaaacatgaaagattcatgtgaggtgccctctactgaaagcataaattttgatgcaatcagagaaaaacattatgagagaggatgatcattaagttaatatcttccaattacctacacttgtccctcagggtaagtcactgagttatgaatggtgtttgttcaactacaatagtccttcctaaccacataagattcttaaatccccttctatcagagaataactcttgtagtaaattaggattcctaaagggagtatcaagagctctcagtagtgttgaggttaaatcactctttccagcaataaacactatttctgaaaagtaaaactgaaatcgaacttgtgtcagttaagtgtcattgcaaagttttaaactgtgctcagtgtataaaggttttatttttccccagtagtactgaagtataattgacaaacaaaaattgtatatatttaaggtgtaacatgtgatgttttgacacatatatgcattgtgaaatgattaccataataaagctaagtagcatatccatcacctcacatggtgaccatttccttttgtagtgagaacaccacacagtgaaatggtcacttctgtgggctgcctttttggtgatggaagctcagcttgcagcagatgtgaaagtaaaacaacttgagtaggacttgcaattagagaaaaaaacttttctgagctctatgttcagaagtcagcttaattaaaaagctgatattcaggatatagtgttttctcttttttttggaaaaaaaagggccttctgcttttagtcaactgaaatctcctttaagaccttttttttggcctggtgatgtggctcacgactgtaattccagcactttgggaggccaaggcaggtggattacttgaggtcaggagttcgaaaccagcctgaccaacatagtaaaaccctgtctctactaaaaatacaaacattagccaggtgtggtggcgcacatctatagtctcagctacttgggaggctgagacaggagaatcgtttgaacccaggaggtggagtttgcagtgagccgagactgcaacactgcactccagcctgggcgacaaaacaagaaagactctgtctcaaaaaaaaaaaaaaaaaaaaatttttttgtttggcgcctttcttgttggcgtgatttttgcctctgtaacttgttcttccatttccttccatgcctgttcttccttccttttgccatctttgatatcacacgaaaaaaatctaggggagacgtctagagaccctgagaccccttaaggaacagagaaaaatgtgccatccgtcccctttaaggagtcttctgccttccttgcggagttccaagaatcattggaaggtttgccttcagtctaaagttctgctctctcttgaattgagttccctgaactctttggcttttgggagtagtaccaggaattgctttggactcagagaacatgacctttgagtgtgtgatggctgataagtcactggtgacggctgcagttttggaagtagctcatagcatttacaatgagtggttattacagctgggggctactcgtttctttgtgcatttaggtaagaaaagcatgatctgcaagcaaaaaacaaacagccacattaaaagatgggaaaaggatatgaacagacacttttcaaaagaagacatacacatggccaacaagtatatgaaaaaatgctcaacatcactaatcagagaagtacaaattaaaaccacaatgagataccatcccccaccagtcagaatggctaatattaaaatgtcaaaaagtaacagatgctggtgaggttgtggagaaaaggtaacacttatcaggttgtggagaaaaggtagcactgattcactgctggtgggaatgtaagttagttcagtcactgtagaaaacagcctggtgattgctcaaacaatttaaaacaaaatgaccatttgacccagcaatcctattattgggtgtatacccaaaggaatataaattattctaccataaagacacatgcatgcacgtgttcattgcagcactattcgcaatagcaaagatatggaatcaacctaggtgcccatcaatgatagactggattaaaaaaaaatatacaaaatggaatactatgcagccataaaaaagaacaagatcatgtcctttgcagcaacatggctagagctggaggccattgtcctaagcaaactaacacaggaacagaaaacataataccacatgttctcacttataagttggcactaaacattgagtacacatggacacataaaagggaacaacagacaccgggatctacttaagggtaaagggtgggaggatggtaaggattgaaaaactacctctcaagtactatgcttattacctgggtgatgaactaacctgtacaccaaacccctgtgacgtgtagtttacctatctaacaaacctgaacatacacccaaaacataaaagttaaaaaataataaaaaaactaaaccactgtacgggattgattaattaagtaatatgtaggtatcaggcatacgtgatcaatcccttcatttgtttatattggaggaaggatgggatccagccccattcacctaggagaaccgcagaggtagcaacactcaggaccttgatattggatctcctggaagtccatttgtagtgagggtcttcccttcagggtaaatataatttttagctctgaagaaggtttaagttttatatatagtctaggccataggtgctggagaccataactagtaaggctaagcctatggtggctttgcaggctgcgaaggataatgggtaatatggatgctaaaatgaaatgtaaattcaaggttataaggatgctcatgatgaatactgacagcattatgccttctagacatagaaatgagacattagatgagatcggtaaattattattcctgctagagatgtaatgaaggccaaggtgacattaatatagatagaaggcatttagtaattatgagtaatcataatttaatgagtcaaaatcatttgttttggtttaaactcattaccaattcaactcattctagtccattttggattcattcatgggctaatcctagggctaagacagtaattaaaatgagtactataataagtactaattttaggctgttcattcggaagggaagagaagaccctcactgcaatcaggcatccaggacagtgatcatatggtcccacactacctcttcctcctccctgggtcctgcatttaacttcctaatctctgctggtagcaatattaactgagtattcaagactctcagggcccctctcaaaaaaaaaagaaaaaagaaaaggaagaaaagcatggtttggtcacctgcaggctatagaaatgcttgccaatgagggataagactcccagaggggatgggctgaccagcgtgggctgactggcattgggttggccagcagcctcagggggctattctgacagtggagtacactgtggaagcatcgcactggctagtcccatggtgcttccctctttttggggacctaggattcagtgtgaaaatgggattcttgatttcggggtatctaagtgctctaccttccagccgtggctgtttttcacacacatatgaagccctggaagctgcaaatgctttccttgcccttttcatcaaaggactccaccttgaagtcagtaatctcatgaataaacaagctaagtggaaaagaccacatatcaagctcaatcagtttccaaaatacaactttctgacatttagttggccattttgaaactctttgtaaataaaatttatgtctataaaagaaatccccatttgtaagcgcatctctctctctgctcctaaaccattagaaattgtaggatgaagacattgacttaatatttacataacaaaccttatctttgtgtaagatatttttcctggcaagcttgtcttgactgggcctttacctgtgtccttctttgcctcagcaaataatggttttaaacctaagttctgtgcctttgagatacaaactttaatctgcgagtcatgtctatggaagtacaaatttagggttacctagctaacaattattttggggaactgaacgggcaatcaagagattgatcgtctaaagcgcgaagggaaactatttgaaaactgtcaaatgaagacccttataaagctattgtgtccggaatttattccttctggtaggttcttggtctcactgacttcaagaatgaagctgcggacctttgcggtgagtgttacagctattaaagatggtgtgtctggagtttgttcctccagatgttcagatgtggcctctggagtttcttccttccagtgggttcatggtctcgctgacttcaggagtgaagctgtagaccttcgcagtgagcgttacagctattaaaggtggtgcgtccggagttgtttgtccctcctggtgggttcgtggtctcgctgacttcaggaatgaagcggcagaccctggcggtgagtgttacagcttacaaaggtagtgaggacccaaagagtgaggagcagcaagatttattgtgaagagtgaaagaacaaagcttccacagcgtggaaggggaccccagcaggttgccactgctggcttgggtgaccggctgttattcccttatttggtcccacacacgtcctgctgattggtccattttagaggcgctgattggtccattttatagagtactgattggtcgattttacagagtactgattggtgcgtttacaatcctttagctagacacagagcgagattggtgtgcttttacagagtgctgattggtgcatttacaatcctttagctagacacaaaagttctccaagtcctcactccacccaggatgtccagctggctccagctctcactataagatctgcttctgtcatatgtctgtatgtttatacgcttgtatgtatgtacatttcactacccaaatatatgaaagagctctaattaattggcttaaagaaaaagtaaatgctgaaataaaatatgtcaggaaaatagaaatgacctcagatgccttttatgtcatgtgtctttagtaattttgggcaaataaaactagtttttacgttgttggtaaaataaaatagaaatgtgttcagaatcatcagagttaaatataactgaggcattttcacctagatctactggtaagataagtttaggctatctctcctagatttttaaggtcacaaatgttgcttctgtgacatttttgatacttctttgacttttctgtgagcttatgttatgtcttggagccattagatttcaggctctaaacaaatggccacagtgaggcctggggacatttgtggagttctcactggcccagttgtgcctcctggctatgctgggaagggacagacattatcctcacagctctgtcctccattgtgagctctataattggtgtgtacatttaagacccaaatgggccctaccctttatagccgtccttgtgatataggagttaagaagaaattacttaggcagatagtaagggtatgggagtcctaggtaaggatttcctttttagtgaaaagcagccccaaatcgttttctaacaaagaacagcctgcaggctgggagcttgcacaggtgaatgctggcaggaaatatgggctagacacgttaaagatggtggctccatcttcccttctctgccagtcacctgtactgtaaaggagcagacaagatggtgccaatcaactggaaagtccacttgcataagaaaattagggtggggcaaccagccttccgcacgcactatgtagacgtcatacctgatctaaccaatttgtgagccctttgtaaatcagacaccactttctcctgcctgcctataaaattggctgcagtccgctgcctccttgactttttggatgtctttctctctctctctctctctctcgcaaagagctgctctcccatatcctttttctgtctattaaactttccactccttaactcacccacatgtatctgtgtcctgaattctttctccacacacaacgaacgccagggtatataccccagagagtatacagccttcacttgggtgtacatgggtacttgggacccaggatgagtagggaagtcagtaaggagtgtgtcatagtttcaaaattcttttcagtaacttaaaatcttaaaatcatgttatgttaaactaagtaatagataatcatgaaatatctgaaccatttaagtaactttaaaaactgaaacattacttattaaacataagtttaagtttatatactttggcattttatttttaatatgatacagaacaaaatatatttcaatctgttaatatacaaaaaattgaggaaacatctttctaaaaattttgatttttatctacgaatacagatatagacagttcaaaattacttcccatgtttttcactggaaattagtatttctaagagttaaaatggtagtcaatatacataattaaaactaatagccataagagaatcaattctacatacaaagtgtataaaaaaagtaagatgtaattttggtgaagaatgttataagacagatatgaggatgttgttttaactcttagaaatccttttatcctatttgatgaccatgaagttttgattgcggtgtaaagtggaatgaagtgactgacctcatttctagaagattctagtgggccaatgctcagctcccaacttctggactgtatgctctaactatgggggacttgccttgatccctgactttgtcctctggctccttgagtttaggtatccactgtgttgaggggggtcgaggtactcccggaccattggtcactacactccgatgggtggtgtcggccaaagcatttcatagtgcggttacagcaagatccattcttgctcacacgtgccagcagcagtggtagtggcagcatggtaggttgcacgcttgtcagctgaggcagagtgctagcaggtgccagagtgcctgcctcccttcatcataggggtggaggcaatgcagctgtgggggtgggagcttggtggagaagcctgattgcaattgtgtgcatggtcatactggtggtggtattggcttgggggtagggtgctggcagacaacacaggtctgtgtgccttctctgtgccctgtaacaggagtggttgttcggggcaggtgaggatccactgttctctgtgcctagtttcactccctcagcagtgttagcacaagagtggggcactggcgggggcagggctggctggctctgtgcctgccaagtctccatctgcagtgatggtttgcggagggaggagtggcagactgtactcccgccacagcagtggcagggcacggtgcacacatactcgcctgctggtggatcaaggaaagcaaaatctgcccattcagacacatgccagcaaagcaatgtgaggagttgcactgggccctagggaagctgcagtgtggagagggtgcatgcaggctggtgcgtaggcatgggggccgccatgctagagctcctcgcaggttaggtatagtgtgccagtgcagaagctatgatgtagctcccagggcgctgcaagcaggtgtggccaggctggggccctgggagaggccggcagactgaggggtgctcaggttggactggccctatttgatgggcaagaccaccctgcagagttcaggactgacagttctccaagggctaaaggctcctatgggagcaagtggagcctagggtgatggccatccctggccctgctctgctacagatgctccaggaccaaaccctctgggctccacatcggctggtttgctgcctcctatttcttctctaagcagctctccctgccaacttgtgtctatggtggctgaagggtctccttctgctggagttccagagactcgtggtgaaagtgagttgctccataccagttcaactcacctgttcccctggagctgctggggcacagggacaacaccaggtatgcagcagacccatgtagggttcccaggtttccccctctcagtccaccttctgtgtgttccctctgttcactttcagtgccttccctttgaagatcttctaggagtataccagtcatctcggtcccttggtggcagctgttttacgtggctgcatctagtcagccatcttgcccccgctcaaaaacttcttactgttaatgtgggaaaaactgaatgctattcctctaagatcttcacaaggcaaagatgcgcactcttgccatttctattgaatacaggactgtatgtatgagcaagagcaattagtcgagaaaaaaataaaaagtacacaagcccttttttcatgtgtgttggccgcataaatatcttcttttgagaagtgtctgttcatgtcctttgcccactttttaatggggttgcttgtttttttctggtaaacttgtttaagttccttatagacgctggatattagacctttgatggatagattgcaaaaattttctcccattctgtaggttatttgttcactctgatgacagtttcttttgctttaattagaaattatagaaattataaattactttgggcagtatggccattttcatgatattagatagctcttttgtttaattagaccccatttgtcagtttttgcttttgttgccattgcttttgatgttttcatcatgaaatctttgcccatgtctatttcctgaatagtgttgcctagattttcttctagggtttttatagttttgggttttatatttaagtctttaatccatcttgacttaatttttgtataaggcttaaggaaggggtctagtttcatttttctgtgtatggctagccagttctcccagcaccatttattaaatagggaattatttcaccattgcttgtttttgtcaggtttgttgaagattagatgattgtagatgtgtggtcttatttttgagtttctctattctgttacattggtctatgtgtccgtttttgtatcagtaccacgctgttttggttattgtaaccttgtagtatgatttgaaggtgggtagtgggatgcctccagctttgttctttttgcttagcattgtcttagctatccaggctcttgttttggttccatatgaattttaaaatagtttttttttctaattctttgaagaatgtcagtatgtcagtggtagcttgatgagaatagcatagaaattataaattactttgggcagtatggccattttcacgatattgattcttcctatccatgagctcaccatcactgatcattagagaaatgcaagtcaaaaccacagtgagataccatctcttgccagtcagaatggcggttattaaaacatcaagaaaaacagatgccagtgaggctgcagagagataggaatgcttttccactgttggtgggaatgtaagttagttcaatcattgtggaagatggtgtggcaattcctcaaagtcctagaatcagaaataccatttgacccatcaatcccattcctgggtatatacccaaaggaatataaatcattctattataaagatacatgcacgtatatgttcattgaagcactattcacaatagcaaagacatggaatcaacccaaatgcctgtcattggcagactaaacaaagaaactgtggtacatatagaccatggaatactatgcagccataaaaaggaatcagatcatgtcctttgcagggacacggatgaagctgaaagccattatcctcagtaaactgacaaaggagcagaaaaccaaacactgcacgttctgactcataagtgtgagctgaacaatgagaagacatggacatagggaggggagcaagacacactggggcccgttggggtgaggagggtgggggtatggggagggagcgcatcaggaaaaatagctaatgcatgatgggcttaatacttagatgataggttgataggtgcagcaaaccaccatggcacacattgacctacgtaataaacctgcacatcctacacatgtaccccagggcttaaaataaacagaaacagaaacaaaaaaaaaggaagtaaaaaataagcctaaaaggaaaaagtaaaattttttctatttgccgatgacgtgatcctacatagagaaaactcaaaacacgtcataaaaattgttaaatccagtaaagtagcaggatacagaatcaacatacaaaaatcagttgcatttctttacaccagtaatgatctatctgaaaaagaaatcaggaaaacacaatccatcataatagcatcaaaaagaataaaatagagggtggaacaaggtggccaaatagaaccttccagtactcattcccctgcagggacatcaagttcaacaaatatcctcacgagcccaggcggcacagtgtgaagacagagtctacctccttaggaagtaaaaggaatgttagtgtgggattttgcattggaggctagtgctgaccccactgcagtggaacacagcactgggcagagcctccaaggcccttgattctaggctggaggccacagagggagcatttagacccccgccccgggtcagagggaaatctgctacctcagcaggaggaatccaagttccagtccacttcacaaccacctaactaaagtggccttccgccagaccctaaaacaaagatttgcattcaggtagattatttggaagatgatttaaggacgtaccagtgcaggagttgtcgcgggacagtgagaccagggcagtttgacaatcaataaagggtgcatcattggcaagctacctgtgaacaaagggagcataattccactggacaacaccaggaggcagtgttatacaagcctaagggtaattccacctgaccaggtacagcacaaagatatgtggcctccaactcccaacatcctgggctgaatagtggtcccagacccatagttttcaagtctatctagcctgcctgaggacatgccaagagaaagccttcgcatagagtcccgagttcacgtggcaggacgccagaggcatgttctagaacagtaggtgccgaaggcacagcacaaggaaacactcactggtggaatgttctcaaaacaaagaaatgataaatgtttgaagtgatagatgtgctaattatcatgatttgatcattacacaatgtatgtatgtataagaacaccacattgtaccctgtaaacatgtatattgggtcaataaagaaacaaaaattatgttgtatagagaaaaatgcataagaaacagcaagagttgtagatcaataccatgaatgtaaataaaaaacaccagcataaacaaagccatatgacatatatcaccctcataccacacacatggggctctttcagacacattgcccagtgccttcaggtagagaggccagtgggaatgaggatgatggatgaagggaagaaaaatttttaaaagaagtctaatgggaactgatgaagaaagtataccataaacttggagtgtgattaaagccttccatcttcctcttttgcctcctctaggttaccagttctgcttttcctggacctgttccaagctctcacgttccacatcacacatgggacatctagtgtcaggctcccagagagcaggaaccaggtgaaatataagagcacagtcctcccagccggtggcatggggataatcggacaatacaactctccacccttttttatggtaagatatgaataaggggtccacaggagcaacctgagtccctgcaactacatttcccaggggcccctggggtaaccctaatgtgactctgggggcggggccagttggacatccaatgagagcacttcccctgcagactttggaagtgagagcacttcctcatagaccttggatgtgggaggattgcattcagtctagttcctggttgccggctgaaataacctggtaagtggaactctgtaaggggctttgaaattggggtttaatcctatctcaactgtgagtacaggagagtaggttctacacgatgtctacatttcaagtataaggttgctcagaaagtgtggctggcacatacttggaagctaatgctgtcactactccacagcttagtggtgacagttacaggtccttgattcaaactgttgggtttacagtcacagccactttatagctgtgagaacttggcctagtcacttagtttccctaaaactcagtttctttttcagtaaaatggagctacgagtactgcttacttaaaggacttgttgtgaggattacatacgtgtattaaaagataactaatgtgtttaaggcaactttctcaacaggatttccctcttggttacttgtaacagtgacgctcaccctcctctgtccccagtggtgtgtgtcccaaaggacccagttaatcctacaggcagcaagctcgtaataattcctgctcctcttgcactagctgataaaaagcccctaatgatcctggatgtccaggaagattgaattctgttgtttgcaatgcctatgggaattccagagggaagtttttgtttttttgaggcagagccttgccccattgcccaggctggagtgcagtggcgtgatctcagcttagtgcatcctcctcctcctgagttcaagtgattctcctgcctcagcctcctgagtagctgtgattacaggcacccgccaccatgcctggctaatttttctatttttagtagagatggggttaatttttgtatttttagtagcgatggggtttcaccgtcttggctaggctcatctcgaactcctgacctcaagtgatccacctgcctcggcctcccaaagtgctgggattacaggcgtgagccaccacactagggacgaagttttattatggccgaaggacacttactggagagggtctccaggaggtatgaatgacaaaaaaatttaactccttcaccgtcagaccgagagcatcaccccctgaacatggacttgcagaattccacagaagagaggagactggcctagacagacagccccaggagctgagggcccaacaggctttctaccctggatgctgctcccatgccctgacatgaggcccactacaatggtatacttgtttgctctttcctaattaagaaacaaacaaacaaaaaatcagacatactgtttgctcttgaatgcttgaaacacaaaacaggtgacaccaccttcctcctcaaaaggaactttttaactgtcaactttctacctgcacgctgcccagagacttattttgtctggcccttgctgtcttcagcagtagcagctgtttttctttagatttgcttttctggcctggtgcaagtaacccccaccacctgcctggccccagtcggcattaaatgggagcagtgagtggccttctggacaagaacaactgttgaatgatggtctttgggtgcggctagtccagcaaccccttttcatccagaggcccagtgagctggcttaggagggggctaggttgtagtgtcaatttagtgggattccatgcccttctttcatggtggtagaggcaaaagaaaagagaaggaataggaaaagaaaagaaaagaaaagaaaagaaaaaacacagaaagaaaagccactcattggctctccttgtaattcttctaatcattaatgccagaaatctatgcagcaggcgtagatgattttatctcagtccacaattgtacttgtgctgattgtagccttaaggccttacagccctatctcataggcagactacctctgggttaaactgcttttaattcttctatgttgggctcttgtttataacttttttaagagaaagaatacaggtttctttagcaataaagaaaaagaaaaccactgctgtatatttaacacacatcgattctagagacctggaattgaacaatgagttctgcatatcaacctgctctccaggggtaccaatccaagaatgtgattattgaagtgccaagtcacatagggataaatcacaatagttggtcaactgttgaatcttgatccttcaactaaacaatattcatgaactctgcagaaaaacaccagcattttgctcaacattcaggaccctctagaagttgcctcattctactctcctttcttacctttcttttacacagctctccaaaatgtccacaaaagtgacttaagtcaggttcccccaaaccagacaccaagacaagaatccatgtgtgtgtgactgaaggaagtgctgggagagccccagctgcagcctggatgtgaactgcaactccaaagtgtgtccagactcaaggcaagggcactaggctttccagacctcctactaagtcattgatccagcactgccctgccaggacataaatccctggcacctcttgctctctgcaaaggagggcaaagcagcttcaggagcccttgggagtcctccaaagagagtctagggtacaggtccgaaagtagaagaacacagaaggcaggccaggggcactgtgagatggtaaaagagatctgaagggatccaggtaagttattgaaagtattctttctgtgctaaccccagtcctcaatccttgccagccagccccgtcttccctcttaggtaccctgagcaggctctattttatgcccttccatacctacggtggaaaccaatagggtttttttttttttcagacagagtctcactctattgctcaggctggagtgcagtggcacgatctcagctccctgcaacctccacctcccgggttcaagtgattctcctgcattagcctctcaaatagctgggactataggcatgtgccaccacacctcgcttttttttttttttaattttttattagagatgggggtttcaccgtgttggccaggctggtctcgaactcctgacctcaagtgatccactcgcctcggcctcccaaagcgctgggatgacaggcgtgagccattgcaccaagacccgataggtctaaggggtctcatttgagtcattgtatataaatttttttttcaatgttttttgtctaaaaaactttagacagggaatgcactctccaattaccttcaactgctacctctccttattttattatacctagatacatcttgccttaacatttcaataatttaaccagaatatgttctgttaaaaatcttttcattggcgggccatcagactgggtgactcctgtggtttcattttcactcattttactgtttaccagtaaacagtagaaaactagagacttcaccaatcagaaactgtcaactaacctctaactagggacttttcactctaaccaaccaaatagcttttctttgtctcactcctgcaaacattttataaaagtttctctcctgccctctcctttcctcagcagagcattgagccacctgtagtctggtgctgcctggctcatgaattgctatctgttctaataaactttaaaaaatgttatacctaaaaaattatcttttaacaattccagtgttgacagtactggattggactctcctagactctggtctttcttgatcttcagatcaaatttttaacgtcatatttctttttttttttttttgagatggagtctcactctcgcccaggccggggtgcggtggcactatctcggctcactgcaagctccgcttcctgggttcacgccattctcctgcctcagcctcctgagtagctgggactacaggcacctgccattgtgcctggctaactttttgtatttttagtagagacagggtttcaccgtgttagccaggatggtctcgatctcctgacctcgtgatccgcccgcctcggcttcccaaagtgctgggattacaggcatgagcaaccgtgcccggccctaacgtcatatttctatctccatataagccaaaatggcttgttcaaaagccataactctcataacttttctactctttgttctgtattggaaggagtcagtgttcaccaacactcctttagtgtgacctctctactttttggttttcatattcatctacttgttcactggccatgaaaccgaaactatcaggatagctcagttattgcatttctcaagctcttttatgtttgatattacctttatattcatgttgcctttatgatcaagtgaaatactagccagaatatttggagcaaactctttcccttcaatactttgaagatacacttctattacttcaccagtggatatttttgtgtaacattctcttgctgtcctgatgttttctctttcatgaaatattttctttctctgccagaggcttgagtagttgtctttaattttgacttttaataatttaacaaaaatatattccagtggcaaacatgttgtatcgaactttcccagaattttctcttttgttttttagcttcaatttcttcatcatttcaggaaaatatttatctttacatacatttttcttaacttttaaatccaggggtacatgtacaggttcgttatataggtaaacttgtgtcatgggggtttgttgtacagattttatcacccaggtattaagcctactacccgttagtaatttttcctgatcctctccctcctcccaccctccaacctgtgaaaggccccagtgtgtgctgtttgcttctttgtattaattaattctcatgatttagctcccacttataagtaggaacatgcattatttcatttcctgctcctatgttagtttgctaaggataatagcttcccgctccatccatgtttccatgaaagacatgatcttgttctttttagtggctgcatagtattccatagtgtataagtaccacattttctttatccagtctgtcactgatgggcatttaggttgattctgtgtctttgctattgtgaagacatgatcttgttctttttcgtggctgcatagtattccatggtgtataagtgccacattttctttatccaatctgtcattgatgggtattcaggttgattctgtctttgctattgtgaatagtgccatacatttttctattgcactttttgcattctccacttcggaagcaccaattgtctttgcattggcttgtccttgactgcgttctattttattctatcttaattgctttatcatttcattagcctttagtaggaatatcaagcttttctgccacataagcaatgtgatacgatattgtatctatatggttcctttctgttcatcattatgtattctgttgattaattagttccatttctgtccttaattagtattctaaggtatgaaatctttcttttcataaaactattattttatcactttatttttagctgttttttattgagtttatttcacatggtccatagccccagatacctgtacaattttttttttcagtttatttttcttcttgaattggttgtggtttttttgtatataacttttgcatgttatgtcttttcttctaatcccaatctcacagtattttgattttgttagttctcatcattttcatgtatgtatagctctgtttccaccttttatttgctgcttgaatctggtgtggctggtgagatgtccagctggggttggtgtagacttgtcaattgaggaaaatgacgagacgagtctcaatcattttaggagatttatttgccaaagttaaggatgtgggcctgggagacaggtctatgcctttctctgaagatgattttaaggactgcaaatttaaaggggaaaggatgggatatcgagaagcaccgttttcatgtaagagctgggtagggaaaatagtgattcatggcctttggctcagtgaatgtgcttttttttgcataagatgacataaacaaaaggggcagaggaaaaatgcaaggactctgcattttacataacatacctggtggctcagatgctactcttttagctgtggtttcagccagttggttaccctgactttctgtggtgtctaattttgagtgacctgggatttttataattgccaaacgttttggttttagagtagcttctaacagcgctgatacttgctgcccattttctatgggttgccctgagtaggttaaatatcctctctctttccatagcatcccaaagttatgagcaaccccaaaagcttagcggctgtcagtgtaaatgtttgcagccttgtcttttgccacttgacaagctcgagtcagggcaatcaatttggctgcttgaaccaatctggcatggggaagaggactggcttcagttacctctagtaaggaaaccacagcatatcctgctctaaaatgtccattttctcatcttcaataagacccatctgtataccattctatctcagcattatccagtggcatcgcttataggtctgtcctgggggtgagaagttggtcagtcatcagaacacagtcatgaggggtcttgttggaagggcctggcaagagagtggctggattaagatgatagagcaggaaatagtaatattgggagaagataaaagcaaaatttcgtaagaggctaagcagttgacagacagatactgggtatgatgagaatttagaagggtctcaataggatgtggcacaaaaatggtaagggggaactcataagaactcataattatttcttcaacagacgtgtacagaagggccatgctgttattactcttacacaaggaggcagccctcgagccacagggtccagctgttggctataatagcctaccggtctctgatgatcaccatgtttctgggtcagtaccctggatgcagtacctccagtttcgcatacaaaaagggagaaaggcaacttgtagattgggtgctgtgagtctggggaattagtgagaatttcctttatttgttatataactggttttccctctggagtccccatgatgagatcaggttgttcattttttaggtatgcatatggagggtgagccacaaaggagaaatttggtatccagtttctacaacagcctgccagtccccgaaatcctctaagttgtttcttagtgatgggcattgggaaagctaaaatttctctcacattatcagggttaatactcagtcctttgaccaagataatatgccccaaatacttaacttccggtaagcacagctgaagtttgtcttcagacgctttgcgtcccttgctggctgagtaaatgtagactatcttcctgggaggaagatgctgtgcctggacaaaggagaaggtcatccacatactgaacgagtgttgagccctggggaaaaattaaatccactaaatcagcttttagtatttgggaaaagtaagtgggactttctgtatacccttggggcatgacagcccacatatattgccattctttccaagtaaaagcaaacaaatatggctgtctggatctacaggaatactgaaaaaggcaccgcagagattcacaactgagaaatactggctggtagtgagtatagctgataaaacggcatgtgggttggggactactgggtgcctgggtattacaatattgtttattgccctcaagtcctgcacaaatctccattttctcctgctttgtttctttacagggaacatagggctgttgcaggggctggtgcagggaataatgagcccctttttagatagtcttgtataataggggcaattccatttgcggcttcctgctatagagtgtattgtttaaggctaggcaggggtttctttggatttatctctacctttattggagtggctgagaatattttccctatatctgtattgactgagaccgtaagtgggaggagacatccttgagcaagcgttcctcttctggtgttaacaggaagactggggaagctaaaaggagttttaccgtttcctgctctttattccagtgttttctcttctcctctattatttccttctgtgtctctatttcatattcccggccacaagacgatgtttcaacactactagtactaaattgtggtacgttgtcaggacattttgtaattcggtattcttggtctcctggccccaattctaaaaaaagttcacgttttgatgaaaaaaagatatgggcattatggatgttgaggagatcacagctcaaaagattgacaggggccccagggcatataagaaacatatggtacctacggagcatgtcacacacaattagagcttgcggcgggggagctgaacccgatggaattgtaaggtataggtttggacttaaaacgtgagatcattttattagacgcagccaccatgttaattctttcattactctgaggaatgggctttctaaatcaggtgggatttatcagagatatagttgtgtctgtgacaattaaggcagttgtaagctcatgatttattattatattaatgtctcccaatttgtttgtcatggtgaagttttaacagctcactaggagttaacttgtgggcaaaatatgggggaggcatgtggcttttcatcttgtagccatcttattcaggaaccaaaaagggggaggcaggtttgcatgacccacttactagcttgacttttccctttggctaaatgagtttcgggggtcccacaatttaatttcctttcacagactcctcagttttctttagtggaggtgaggggaggtggctatgacaagagatgctctgatagcggatcttctgtatatagatggtccttgtttcttttgagtagcatcatacattaagggccttaccttgtttatctgcctcaacatgccgaattatagctgtacctagaggaagaccaggtgctagcactacatcctggtctttgatgtgtttggtatatgtcatggtagtgactgggggcatggaacttggttcacccttccttgctgatctcatgacagttcatcagctggtgggttgcctcgggaggctgtggaagccccgctgctggtggcttccacagcttccaggtttttaagccagaaggctgtaccccatcagcgttgcacccatctccatagttgtagtttccacacacttatacaactcaaatgttcactttactgtgcagtccattccctctgttttgtgatttttaggaaatcttcataatttacggtctacaaaactattattttgttttcaaggaagtcatgttatatatttctgactgtcttttctcttatttctagaattcaagccaggaagaagcagcaatctgtcttctggattaaaactgaagatcaacctactttcaacttactaagaaaggtattaagggcctttctgagagctctcagtgggcttcctaagcacgttcactctgcctcctttaagtcttatatttatgatcaagatgaaagggagggatgtatcactgcacagagattctacaagtggatatataaagctaataatgttttcagtgagctcttctctggcaactactttccaagtgctttcagcattccaccttgaagcacaacgttaataatgcacaatttcttatgttcagccacagaatgttcacgtgtgatttggttacaacatattgctctatccaggcctctaacaaaactgacttctttcaaatggacttgcagttgctgaattccaaatcaacactttatcttaaaaacagaaaaggaggggaagggtggagggaggggaacagagagggtacaagaggcaaaaaaagaaaaagaggaaaacaaatgcttgtaaacaagttaaaccaaataaaagagatataaagtaatttcttaaaagaaggaatgatattctaagcaagaatcaaatatccaggtatgtataaaccgccttcgtccttttagatcggcttctctctcttctttacatactcagtacaaattctaggtgagggggcagagaggggttggcattgtctgactaaatacatcttgttctctctctgagtggtagaactttagagcttgaccaaatgttacgaaagggtgctggtggaagttaggatgagaagaaatgcaatctaatagatttggagaaatgatgttgtagacaccaagaacagagaaagttggaaactggcaatatggggaggatagctgggtcagaaaggaaaaataggagaatatagaagaaatgttatgagaagggaaaataagagatgctccacttatcaccattcatctcggggcaggtccctttgtacaaggtcatcctcaggccataccacatacaaaagagttatacctgaggtctgtacagcactgttacaatcatagtctcaaaaggttaaggctctatgatggcaggtttaaaaaaccttttctaaaatatttaacaaaataaggggcatttatttttttttggttcacattacctgaaagttaaaagatagctttcggcttcattcaggtctttcctcattctaccttctgttgtttttcatctcttggtaaacttggtgaactctttgttagtgttgttcttcagtaggttctcaccaatagctttgaatgaataccccaccagcttctactcaccaatagctttgaatgaataccccaccagcttctaccttgtagcagaatgtacacgcttaggtttcagcaaaagttcctcagtaaagtctcagatctacttagatcatatgttatccatgagccaagcactggtcctagagcatatgtgttcaaattggtcccacctagtccatgtgactatccataaggcgcaatatgggcagcctgttctctacacagtatccagaaacatcactttgattgtggcaaacattgctcaattacaacccttctctcaggcctctctcatttacatttctcatttcacttacagtaaaaaccaaaatgccagtcttagctccaaggctgcagttgcctgtcagatctcatctcagtccactctccttcttactcatgtgctccaattacccttgcttcctgaatgttttttgaacgctcaaggcagtttccagcttaaggccttgttattttctgttttcctacttggaacaatcctcctcacgcatatccttaggccttattctctggcatccttcaaatcttagcgagtgttttttttttggtgtgtttttttttttttttaaaccaactaatttaaaattggagctctccctctgtacttactgggtcctttctttactttagttttcccagggcacttactacaatctaacagattgcatgttttatccatgtattcaatttcctatatatgtcactccaactcccactaaaatataagatttttgagagtaagcaagcactagaacagtaggaaacacattatagctattcagtgaactatttcttgagttaatcaatcaatggatgagtgaatcaatacagttctttgagcgggaaactttgtataaggctcagctaaaagggaaattgagtgggtcaggtaccacggatactatacactctattgcatgattctcctgcctacatcagaagacgtttataagcctattttaaaggataccagttggaatctctcttttattaatcaccaagagaaccatgaacaagctgtttatcatttgactcatcatttaatcttgatttccagcttctcacacttgaaagaagacataatacatttctcacaggattctgggactattaactgaacttatgtgtgtaaaaggaattcatacaatgaaagcactagaaataattattatacttataaccattgtatttttacatgtttaaaatatagccataattagcctactcaaatccaagtgtaaaagtaaaatgatttgctttcgttttgttttccttgcttaggggatcatggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttagaataaggagtaaaacaatcttgtctatttgtcatccagctcaccagttatcaactgacgacctatcatgtatcttctgtacccttaccttattttgaagaaaatcctagacatcaaatcatttcacctataaaaatgtcatcatatataattaaacagctttttaaagaaacataaccacaaaccttttcaaataataataataataataataaaaaatgtattttaaagatggcctgtggttatcttggaaattggtgatttatgctagaaagcttttaatgttggtttattgttgaattcctagaaaagttttattggtagatgagtaaataaaatattgtaaaaaaacttattgtctataaagtatattaaaacattgttggctaatataatttgaaaaaaagtggttttttggaagacttaggatattatggtgctacataatttttcctcgatgctctcttcctctcatctttcttgtctcttaaattgctttacttccttgcacactttgccatacaagaatgaacatgagcttttcttgtgtagatctgagttgaaatcctgtggacactgggcgaattactttttagatctgtagctctgactcctcaggcataaaatgggaataatgcttttacagtttagtggcggaactaaactcccaaaattatttgttatatggatcaagtaataacgtcagtaatgtttttggtacaaagtcattatttaataaaagttattgttccatcttgcttgccccccca

SEQ ID NO: 10 - DNA, 149049 bp, Homo sapiens
gtgagtgttccctcatctcatgataccagtatttgcactgcagtaaaatgaatgacacacatgttggggttatcatctatggattcaattttgaaagtgagtatcaggaggcattatgtctgcacctaggaggctttatgctattggtaggtgggttttgttttatttctggtgatgagggcttttaaagatacatatatgtgtgtataccagatttggaggttttgtgtgtagattgctaaaaagaaagagagaagtgtgtagtatacttcatttttttttaaagctgttcgtttgtcagtgtggaggatttgttgtagagtgaataaaatgcctaatttgggaagactggatattatgaccatgcatttcaagtgatctagtgcattctttttaatttttatttttaaagatttttagagttgtgtaatccactgctccagttttctgggggagaattcagctttttaaatgtagctccttaaggaaatgcgaggaccactgtattgcatggctccaggaactcatagtcaagaactcacacttaaactatcctgctggctatgtgtacaatctccagaaatatgatgctctcaacattactcaaacattatgtaaaagtagaattgttaccaacaattgcagaaggcttgctattagtgaagttgttcattattttaataatgccatgcatctccatttaaatatcttcaccgactgcaaattatatggttattacacaaaataggtggaaaacagtctgagggtgtaaattacattcttgggccacatcaaatcaatttccttttagggataagaacccgggttcttaattcccagccatcctatgatgcacaccttcaattaaatttatatttgaaatgatgcttgatattcttttttctcaagtcctaaaaatagagtaaataggatgggctaagaccccttggttcatctaatctttcccccagtgtaggattttcctatgaaccattaaaagtgttataatatatgattgatattaattagttttctgtaaagtactgcactccttaacatgaactgaactagaaataaatatattaccatgaattaagattttattagttgcaaagaagaactggatgaaggcacctatgtgaaatcctaagtacaggcgtcaaattgaattaatgccagcactgccttgagattaatttgagtactgaataagaaatagtatatcataacataactgtgtttactgaatcgtttttggcatcaaaaactaaagctacattataaatgcaacaacaggcttttctcccttggaagagagaggcgggtgcattttgtaattaaagtgaatattaccctctgaaaaatgcttctagtctctaggaaggaaacagccttcttgagaacactgcatccttgtatatatctcagactttgcatacttggtgttgctctggccatcttcttcatcctagagtacggtcagctctattctccactcactttatatatttttgtcttattactctctatatgttttgcaacagatgtggagggtgctgaaaagttttatgggattgccccagggatgttctagaagggattgctgattttatagggagaatgattgcacagcattcaatacagggccatgcaggctgagccctgtgaagtcctgaggatcacttttgacagattgtgatgcgagtagcgccccctggagttgtgcattgctggggctctgctctactttcccttaataattctgaaatttcctgattttataaattttatatgcatctatgatataggttacttgaagaccaaatgcaaaactttaaagttttgtactgttaaataggaatactaggcacatcactcatctaattttaaattgtaaagtaactacatttttaaaaattttaaatttaattttaatgtctttgacttaatatattcaaaatattatattaacatatagctctaagttattaatgaaatattttacattctattttttgtattcagattgaaattccaggtatattttatatctgtagaacatctcaatttttgtttggacacattttaagttctcagtagccatatatgtggctagtggcgactgcgttggctggcatagttttggacttagatagcaacttgccagcatttcactacacagaaaattgctttaaagaaaaaaaaacccttaaatatctaagacaaaatataatgtatcctttatgtcatttatcaatttaagaagcgattatatgattgatcacaaatttgcgagaagtgtgaatgctaagacaatttagttgatagcccactggtggtacaatggactttatattgaattgttttgtcctgtggctttgttttcccttcttccctctgtgtgtatttcagatatcatcatttaaaacacaatttgatactttgtggttcctctcattgtcccaagctcatgctgtcttgtcagttttcatgcaccatatggatgtcttatttcttttcttttttcttttcttttttttttttttgagacggagtcttactctgttgcccaggctggagtgcagtggcacaatctcggctcactgcaacctccacctcctgcattcaagcggttcttctgcctcagcctcccgagtagctgggactataggcgcatgccaccatgcccagctacttactttttttttttttttttttttgagacggagtcttgctgtgtcgcctaggctggagtgcagtggcacgatctcggctcactgcaagctccgcctcccgggttcacgccattctcctgccttagcctccctagtagctgggactacaggtgcctgccaccacgcctggctaattttttatatttcttttagtagagatggggtttcaccgtgttagccaggatggtctcgatctcctgaccttgtgatccacccaccttggcctcccaaagtgctgggattacaggcatgagccaccgtgcccggcctcctggctaatttttatatttttaatagagaccaggtttcaccatattggtcaggctggtctcgaactcctgaccacaccagatctacccacgtcagcctcccaaagtgttgggattacaggcgtgagccaccgcacccagctggattttttatttcttaacagagaaattcttgaaagacttttggctcaaataactttgtggccagcctaatggaaacaaaaactgttttcttcacttgctgcttctggtctcttcagatgtagtgccagctcgggactggtatgaggctggattttatttttctttaggtaagtagagaaacaaacaggcacctggcattcctacaacttgtgataacactgtccctcatagaaagtcgacttactataggacttaaagagaacatctgatgtgcttggtttccaaatctttatttttcttaggtgaggaaggcaggtgaagagcaaagacttgcatctactgtaatgttgcttgattttacattgagttttaagcagtcaaacatgaatggcaggcatcattatggagtagctattatatgccaagcacttggcttatacacattttctttaaccttaacatgagccatgtaaaataggcatttatatttccatttttgtagatgaagtgcttgaggttcagatagtttaggtaactgtcttgagttcctacagatagataataagtaacagatctacattgtctgaccccaaagtccatgctctcagagaagagggacacattttccaaccaagtcaatgacaccgttcaataatgagttttgaaccaagaagaaagactaaaattttagagttgtaatattccttcacttcacttattcaagaaataaatgcagagaatatgtaatcctattctattttttgatagatgaggaaatagatcgagaaacttaaagtggctttgtgcaaggtcagacaaacaagcctagacatcaagtcctttgatttctgctccaaggctgtttgtctaagtggtttaagggcccctttaaggaggtaagttggacatttggaattttttttttttttggacaggcagcaaacttcaaaaatttatggtatagaaacatttatttctctttcttttctatgcattttaaacttgttatcgaagtatatgatactgaaaagtacatgtatcataagagtttagctcagtgaattgtcagtaacaatgtacccatgtaaccagcacagacagcaagaaagaaaccctaactagcttgctggagccttcctcccggttgactgtggttctccctgccctgccccaaaccaccacccatggcaacctctcacctgatttgcagccgcctaggttaaatatctgtttctgtgctttatagaagtggaattataacgtatgcaccttttatgtgtgtctggcttcctttgcttcacattacatttctgggatttatctacattttggtgtgtagcagaagttcattaattctcattgatatatttggccatactttcaagtataaaatccctaacaaccataatactctaagtggaatgaataggtttatttcacattaattaatatttaaattgcttttttcctagaaaattattagctgtagttttgtgtgattcgggctaaaacaaaataacaaagctgaaatatggtgcgtcagcagttacaaagcataacacaatgcaggagatcactcctgtcctgtggttttacataataaataacattgaatgatgtcatagagaagacaaagagagcacacaagctgaacatacccacaggagagccccaggtgggagttcccacttagtggctttgtatggctgtacaaaatgttaggtgtggcctgtttttaggtggcctgcatgcaaatggatctactaacatggatggtagaaaggtccacctcaggggctaggcgcggtggctcacacctgtaatcccagcactttggaaggccaaggccgggggggggtggatcatcaggtctggagttcgagaccagcctgaccaacatggtgaaaccccgtctctactaaaaatacaaaaaaaaaaattagccgggcgtcgtggtgctcgcctgtaatcccagctactcaggaggctgaggcaggagaatagcttgaatctgggagacagaggttgcagtgagctgagattgcaccactgtattccagcctgggcaaaaaagcaagactctgtctcaaaaaaaaaaaaaaaaaaatacccacctcaggaattgttaaagttgtttttttgttttgaaaagaggtagagaaagaatttactctgatcacctgcttggtgcaaagtacaatctggacccttcaaagaataatagaggttttggcttgtttaaaatggatctctcatcaacctctttttgcagattgtctcacaagcacagaatcaagatttgctatgttagttttcttattgcttcttcttcctggttgcaggaaaatgtgaatgtaatgccagtgaatactgctagtgagaacccagcattgtgtgagaatagctgagggtttatcaaggcattgtcctgactgaggtttatcatttacctggtcatactttccttactcctatgttgtcagtgctccctctcctaatttctggtagagaagttaattttcctgtgactaattcactcaaccttaaaggaaaacctccaagctggttggtcttaggtggcatcaaagcatacatcttctacctcttgctcaatagagtcgtatgtacaaaggaaaaagttgaaaaggtaacgctatcctgtgatatggtcttggtttaatacatttgctaatactgttatggtaaaatattaggcatatgaccttttttcctccctccacaccctacatgaatatctcagctgattccttctaaattaaaaatatgtacagtcttttaccaaatataatgagctttttatttaaggagggtcttctcatattaggaagaaaggatgttattttaagctctcatttccttagctgctgtagaccttattcttatttacaaaaccctgaatataatatccacccttctttctaaatcttctctctctgggtgacaccatttctaaatcacttgtaatgactaccacatcagttgtgtggttttcacacttgctgtgcatgcagggactcggtcttacatatgactcgtgctactttccagaattaatgataaacaagatgaaagcccactgtttctctggacagctacctgagctttgtaagaaatgctggtctctaagaagctgatcttctcagagccaatacctgtggttgaaagtattatatttcacaagttctctagtattctttttctagaatcgttgagtggttaaatatctgtattgcaaggaaaatgatgaagctgtgctctttcagcaacactgagcgccagttgcctttcttgtacaatatctctgatttccagtatctttgtgaaatgagacatttggattcaccctgtgcaaagaaggcttcctgagttgtctgtctctgtcaagacaggcacatcactgcattttagatctggcagagatctttgatttaattgaatccggccatctttgttgacagataaggaaaccgaggctcagtatcattacatgaatcacccaaagtcaaattgctggcaagtgacatagctgaatgagggccatgttcttcttaccatgcactttcctttcattttgggctgaatcaagatcctcaaagtgactccacctgtcagatagacttgagtctccagtactcaccttaaatctcataaggctggctgactttggtttaaacctcattactcctcttcttacaaatattcttaatggtcaaaataacaaacacccatgtgtaggaagaatgatctgcagaaaaggcccaggaaatttgagaacatgaaatcaaattggctgatataaagctttcattcctatgaatatagttgaccttccaggggaaagaaagtgagttatcccctcttgtgatatttgagaagccaaacatgagctttctgcccaagcacggggctgcaacatggcagcatttacacaggttgtttcacatttagggatgggctgtgttccagaaatttacttgtatgtcaccgggttgaaactgggactgcattttcctggtcaaatcaatttcagtcatctccagtggaagccatgtctccaaacactctttctctaagcctttgctggtggcccctccttttttccccagttagttggtagaccctcttctcaagaattattcttacctatttatttataccattcttgaaaatatttactattgtataaatgaatgaagtttctttaaccccacccgggctaattaagatttttaaagagaaaattgactttacaattgattaaatttcagattgagaaacaaagggaagatggtagtcatgtctgggggttagtggttttgggtctacctctgaggcaagctgatagtagctgatagcttccttctctccataattctgggatttctaagtataccaggtactaacttccctcagtgttgctcatgagctttgcatcctaagtggagcagctgttggacttggtatgacaggcagaaatggcttcattttaaatatatgatgcatatttgagatataatattgggcgtcaggggctatttctatctgctacattcccagtatgttaagcaggcatggctttaatactgaatctctctgttcctctcaaaactgaataattcttcttcttctgaatataaaagtcatgcatgtttataagagaaaatttgaaaattacagaaaggcacattcacataaaggaacgtaaaaagtacttataacgtcgtcagccactacgaacagcttgttacatttcctcctcatcctcttcttctttctgaggatatatttttacaggtaaacttttcatgattatagttttttcaagcttcattttaaaccctaatgtattttgaacactctcccattatgctattaaatatattttacaactgattttaatgataatattaaatataaatatgtgtgtgtatatatatatacacacacacacacacacacacacacacacacacacacacacacatctctataatttattgaaccaggtcacttaatgttggatattcacattgcattcaagttttcaataatgcaaataatgtcgcattgggcatcctaatatgaaaaatctttgtacacattcccttattattgccttaggatgaatttctagaagtagatgttctaggtctatgaggtttttagaagttttgaatatatattgcctgcttgctctgtataaaaattatacccagtataatcctaccagtagtatctgacatctatttttcgattgagctgctaaatgtagaggtcaatcctagaagcggtcgtcttggttaaggatgttttctcaaaagtcttgtgtctaattgggctagcaaatataaagtaagagtttatctgtcaccacaaaactgagcttagacctcaaagctaattgcttcttaagatgagaatttatttcccttctacctctccgacatgtttgggatatatgtatatacatatcagtttagctagagcaaaattcaaatatcaaagcactggaaaaacccataacagaaacacaagtcaaataaccaaaaatctttccaagactctgcctggtggtattaaaaaaaaaagaaaaagaaaaagaaaaaaatatatatatttattgttacctttttgagactatttgcaaaatacagttttgttttgtttctctaagatcgagaaaagctaagctaattagtactcaagcactaaaaaataagtatcacgggaatggtttgattgcttttttttttttttttttcagttaaacaatttgtgtaccttaattttccctggcacttactaagttcagctagtgtgaaaaaaaaaaaatccttcttagtaaatgaaatgttatgttatgtattgaagttctgtagcactttaaaattttaaatagtgccaaatttgacaatatgtaatatgccttgttcagttccacttaaaaaaattgctagataatcctattgaacatttattgtctaaataatcaataactgtctgcattatagataaattaacctggaataattaaggtaaatgaaaatgtggattcacaaatacaaccgagttgaacatcagacaaaatcagattttaaccacccttttattatctcttatctctgtgcttaataagtacaattgttgctttaagtttagattagtccaattgactgcaactcagattaactttcatgttattttttgttttaatatgaaaaacaccaaaagcacattttgaggtccaaattaaaatagaggctgactcagttccatagagccggtctgcagaaggttttactggagatgagagatgtttttgctaaggttgtctatcataacttgtttattaaaaaaataaaaataaatgctaggagacattcaagctgtcttgattttcctctagttatttcctcaaaggttctttgttcacatggacatcactgtggcatttttttcaagcaaaatgaggtttaattttatagtatttatagaatagaagtctttgttatatcctatcctgctaccaacttttgtgttctatgcagtctctgcttctaaccagaggcccaaagcatgtgtttagaaactgatgtggggtatcaggatcaattagtccctctaggaattaaaagcaagcaattgaatgcctgttaacaatgactaacttgaaaaatattagcaattctaggcaggcccctttgctttctggacgaatgctctaggcaggcagcattcccaggaatattggtttccagctatgtagactgtccctcagttataaagttgcctccagggtctttgctatggctttgatttgaggatgattattattcttatggatgaaactttagttcttcctagaaaggctttcagcgatttgcatgctctttccagctgccctccaaaccttgcccagccttatttttctccatcataaaatgggtacacaggtcatttttattggatagtttggaggactaaattgactgagatgtggtatatgaagtgctgatcttaatgtctagcccatacgtggtctgctgtatatgtcttgctttccacctttctttcttgagaagtttctgcatacatatattcttatgtagttattgtataaatagtgtatatggaaacattcccgaggttgtattttcctgttctttcttgatttagaaaactaaaactacagtaattttctgctgtgtgtaagagagaaaatgtgcttatgaactgtattcagcaaacttaaaatgttgaagctcttggtcacctttttatgcccagtaatgataaactgtcaatttgcttacgttatttgggaatttactagcaacttgctgcagatatcacagtagacacatctcttataatatgtatgatctgaaagaagcagcagtctggtagttttttgtttgttttattaaaataaaaacttataaacttataaaaacaaatgaacaaatatatttatcctaatagctcttctgagtttgcttctgaaatcacctatattcaatatagacaacaaaaccaattgtttttgctattctctgaggtttttgagtttgagggtttgaatttgattctaatttttagaaatgggcagttgtctgaaatatggagggatgggaaaagcctttaatttggagtaggagtgaggaaggaaacccaaatgttatacacttcagtcaacgtatttgttagagaattgaattattctcttgaggtttttttttttctctttgttagcaactcgagatagattctcctgcctctactaatattgaaaccctggaaaatgttaacagaactacagaggggagaaattatcaggatggaatgtaggctttgtgtagatatgcaacattgggggcactcagcagatgttaataaatacctctttctattgttgagaaaaaatgggtttgatttgggtgtgaactgcagtggtcaatgaaaggaacttgtatctcaccagggtgtgttttaagcagtagaagaggaatctgggtgttgatccaagtgacgttggtttttcataccaaattattccccatttttaagggttgtcatccccctaaaattgtaagctctcttgtgtccatgtcatatgctttcttggcagtccttgtgatacatggctgtgcacacagtaaggtttcaatagatccttgttgtctgaaaccagatatttgggaattttggagacagagttgacgaaggggtgaaaggagggctgtgggtagagagtaagagaaatagtcaaagcagagagagaattaaatagagaaatggcccggggaaccagaaaaaaaccaaggttggtgagcaatgaaccatttaagttctcctgagaaaagaaaaaaaaaaaaactggactgaagaaaaaatttaatctgaagagttaattaacaaaattataaaacctctaaaacatccctctcattacagttgtagttttaagacaaaaaaaaaatatcgtggaaagcactctaatttgtcctaggaatctatttaattttgatttgtccagtaatagaaatttgagggggaaatgcaatatactgtagtttatgagtcttttaaatgttgttacttctgaattccatcctctttgtgatagtgagagtgaagaaaacacaagtgtatttgaaatcacttctggtttcagtgcatgtgctgatttgattttttagaagtagaattagatggcaaaaaataagaaaaccctaacaatacaatctgggcaggttagaatatcaaaaattataacgagcctgttctaatgtaaagaacatctctaaaagatgtgaataggttttaaaaatatgatgaatatctagcattggataaacacaaataaaggtatcagtgaatatcacaatggaagaatcacatgataataattaataaacattgactcttcttggccaggtgaccaatattatttcacagttgatccttgagggcagagccaatgacctttgtcctgaattttaataatttactgaagttttacattaaatcagaatataattgggaagaaaattagtgtttctttgtggggagtgcagagtaatgccactaattgcttgtataaaagcattcccgaggttgtattttcctgttctttcattagaaaattaaaactacagtaattttctgctgtttataaaagggaaaatgtgctggtgaactgtattcagcaaacttaaaatgtcaaagctcttggccacctttttatgcccagtaatgataaactgtcaacttccttacattatttgggaatttactagcaacttgttgcagctctcacagcacacaaatctcttataatatgtatggtctgaaagaagcagcagtctgctggtattttgtttcttttgttctttctttcactttaatatttgagcaatttaatatttaaaatatgtgttagggcaaataaccatgtttttctgtttaaggagatggacaatgaagaacagtgtaaattaacctcagtagaataatgctttacaaattatatttaggtaactgggggattgttttcaggtaaattattatcaagtaaaagaattgagctgattctaaaagtatattgggtttaacattttatgaaaacatgtttattcacacagatacatacacgtgtacatctcctgggaacttggaagggttaagtcagaccactgtcatgttacaggaagtgtttttccactgtgtccagtaccttgagtttgttatgtattcaatatgtagtgtcatcataaaacagttgcacctacctgcattagccctcattgtctcaaggtacaagctgaaaaataatagaaagtaaagctcaggaattgaatatttctgctaatagtgtgttggtatttttccctcagttcacagacattcttgatttcaaaacgcaaactacacaacccagggcactagggttggaattcaatgtttattcaaaaaggcaccctaaggcagttagggaggaaacgctacatgtatgaaaaataggagccgggaatcaaagctgatctgagcagagcagcagcgactgtatttactaacacttgttttctgggagcctatgagagaaatggaaataattagaaggaagctgaaaggatggggttttgtggcttgttctccttatatggagcaaagaaaactgcagcaactcttcgggagctggtattccctactgccatgggggcagccgaattctgggtggaggagtttgtttataccttaacacatacaggctattttgttgattaaacaagcaaaaaaaaaaaaaaaaaaaaaaaaagccccgtttgcgctttcaaacactccctcaatgagaaaatgtctcataaaaatgcatcatgtgataagctcttgctttagtcccaaactgagcttgagtccacttggagatcttagaattaaagagttcttagggaatacacgttttagctaagaatatagttactctgtcatgaaacagggagctttgccacttgcttgttttggaaggaaaataaattaaaaaaagattgcaggggattttggttattatatggccagggctccgtttagagtctgtggcattcaaagctggctttaatcacagcatgatgcttgaagcctccaaaagtctaagtgtttcctttctttctttcttttctttttctttctttttttttttttttaaagcgttacttcactgaagcagagggctgcctttgagtgacgtcacgagttagagcagcaagctgcacaggggaagggaggctgggtgagtgacagcccagcctactttttaatagctttgtcatgtgactggggactgtagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgaggtgagctggggcagggctcggcgctgcagccacaactgacgcttccctcagatgctattattcctgtaaggggggatgggcttgggcaaagagaggagccaggaaagtagtccaggcaggagcttttagaagaatctcaatcttatcttaactccaataagtttgctattttaaggtggctctgagatggcttgagcaaatcaaagcttagctgctgtcatcagtatctgttgcagttagaaactctttccatgtgactttggcactgtttctactcatatgcaatatttatgctctaagatattgatatgaatcagaagctgaagtctttccagtggtgtttagtggcctggttggaaaaatgccatttctatttataataagacgaagataaaaatattaaaatggatgtgttcaaatatagtccgttttgactctagtccggatttttcccccctctctctctgttcatcagacagagaacttacaaaatcctaaataatcctgctgggctattttagattgcttttcccacagaacacaaaacaacgatgctgcttcctttaaaactcctatacgtggttgaaagatttggccagcgaataaaaagaaacgcctggcagtgcaaggttttccgttcgcgtcggtggcagggaagccaatggttaaatcttcctgtaccacggagagctgcctgaagctgagagagaatagagtttatgcaggactgtgtgtggagctgctcgctgctagtgtaaaaatagacagcaatacatcaattccacagtctctgctggctacaattcatacaggggggaaaataacgcaagcagtttcctcgtaatctctggagtctagtggggggacggaggacctcggcgtgtttgcattcagcacaatggaatgctctcggaaggaaagtttgggcaacttgggaaacaagcaaaactttctgtggactctggtgagatggactcgaattgaattgcatggaggatcccagctgctaacaatgaatctggcaaaagactgcgagtgtttcctctgggtagctgggggcacgtagggtaagggggaggatcaagcccacacgtgatttgattaaataagatgtccatgtggtgcagcgatacacatctaaagtgaaaataatttggccaaggccgtctgtgaatgcatttttcctatctagcgaggcatgcccgggattcttaactctttgctgggtttgcaaatgttggctccatttgccctcccttgccttggtagatcgtatttgtggattgtaattgttatcttgttctgatttcttggtaaggcggaatagatatggataattcatatgccctgtagccattatgagtcagggttataagtggcttcaaagtcctaattgcctttgagtagccggagtgtcctgtgggtggttgtctggctggcactgtgggtctcagctgctgtagtttcatttttccatcatgtattattcctgatgctgttaggagttgattgaggaactagatcatatggaaataaggaagatttattttaatcattggaattcctgcagtcattttcaaataaacatcagaagcatttagaatagtggcctttaaatttttttcttaaggaggaaaggtcttggctacttgtccagccatggatagagtcgccagtcggctgagattggccagtcacttctctgttgcactataggcagctagctgctagaagctttgcctacatggcagcggctctgggaatcacctccgcctgtataaaatattacgagcagcaggtagcgttggcagttttcattttttgaatcattaatgtttgctgtcatcctaaaacgtattatgcccttttgcacataatgacagggtagtacattggttaatataggcctatatcactatagctacttggagtgccccgtgtttcacagtttaatgaaggtgatatacagtaaggttactaagattgatagagacaattcacatgacatacaccccactaagactgtcattctttactgcccctctctccaccccctttcccctgtcttaactaatttttttaagaacccagtttcttttttcattaatataattaatgtggccaagtccactccttcttctctctctctctttaaaatttaccatcaatggcacaaaaacctccaaaaggttaatggagaattatacttaattataatgattcattatcatcagtgcagttaagctaatttattgtctgctccttaactaagagaaaagtctgttggggtgaaataacatacaataattagccttttgtgtttagtgactgctttatcctcttaaatcttattataaaattgaggctacagttgtgaaatagctgtcatagttgcaaagaggcagtagaatgtgtctgtgtaattgcaataaagcacacctgttacagaggtatagggaaacagtaaatatcagcatgtcagatgaggacagttacagggcttggactgttaagtctggcattgtccaaaggccaaatataaattaataacaggaacacttgctaccactaatgtgttttagattagcaggataatgccacattcagaagcacagattttattagcatgtcaacattggcaagaacacatgcacttttctcaaccataacataaaagcaaaatgagagagagagagagagcgcacgagcgaacaagtgagaggaaggaaaggaatatgtaaatgacaagatagcaccaatacaacaaattgacctggtcttttcaatggttttcaaaagttatttaaaaatacatatttatggaaggttaaagggttatgagcaagtcatgccaaagagggcagttaaagagagggacaggaagaagttgtccacaaatcagtatgctactttagcattccaaaacatggttggttcctaagtttcacaacaggaacttaagccatatgtagacagcctacattttcttgattatttttacttttgtgttgctatttttgttgttcatgttttttttttttttttttaaagactatgcccctataaaatcctagtgtatcttgcaccgttgaaaaagttctcccccatctctgaattggtgacattgaggaaaagttaagatagtgtgtttgggcttggaggatcagctgtgtgggcaagaatggagtctgggcagtgttacatccacaaccaaatatgagcattgtaccagaacgagatctcttcagcccagcctccagttacttatatgccttgtcaagtatactgatctgtaattttgggctaactcagataataaaaggaaagaccaataaaatgataaggaaagagttttgatggtgaggagggccctttctttgcattcccttgtccctgctgccagggatctcactggggtccaatggtcttagagaaggatggcaatgattttcagtctccccccatcctccccttaccaactgctgactccattacccagtacttacttctcagcgtgttgcttttgatcacgctgctgcatatgacctgtgtaatgtggcctgctaggaatccctgccagggataacaggggtgcttgagaaagaaaatctgcataaaacttatttcattcaaaatgtaaatgtcaaggagcatctttcattttatgcctaactgcagcctggatgtgaacaattccacagcatctctcctgaccttggaaggcagggccatgagggtgctgcgtcagtgtgtgcctcctgatttagacacccccacttacaggtggatgaagtccttactgttctggcaatgccagacccctgcaataggagttcctgcagtgttctttactgtctgcggactgacattagcggttaggtagccaattcaagtttaggagaccacctcattggtaaggggagtccacttgcctccaaaagccgcatggtaaaacagttaaaaagactgtctatttcatgtaaggggatgaaatgctttgacaatctaaaataatcttggtgataagcagcccagccatggtagagatattttaaacctctcaatatgtagaaattattttaaaactctaaacaaaaatagttattttgaattcacgtagagcacagtttagatatacataaataatgaacaaaatatagtgatggtatgctattgtgagttttcttttccaggtactaggtgattccaaccgtacacacacatacgtgtgcaaacacatacacacacacacacacatcttgcaagttacatacaaaagccgtatagaaaaaaaattatgatttttgtccttcatcttaaggaacttgcttttgcctttaaggatgaagtccagaaagtcatgaagagtcaaataagagtaaatgatttaaataacaattcaggagaaccacagatgagtcaaagggctttgcatcattagttgctaaatgaattatttggattataatgcttaaaaggagtgtaaatggagaaaatttttcctagtgtagttcctctgttctttttccatttagcaatagtttattgagtgtctattatgtgtgataaaatttccaaggtaaaatcaagtttgtattatggttaactataagacagtttaaaactttggaagcagtaactatcaaacaggtatcaaggattttgtacaaagaggtccaaaaatatctagttgatttctaactggaagaatcagagaaagcttcgtggagcttggtatttaccatgtgtttggaggtagcttttggatggaataaagcagggaaattatccttcaggagccaagtgagtaaagattttaggatgtttttcctggtgattaaagtgccagaaactagctttggtagtgtagttgaattaactaggcttaattcctatcacatgctattgcagtttaataaattcctgtggttaatggaagcttttttaaattttttttttctgcctcctgcagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgaggtaaggacatcctttggaaacattaatttttcattgagtttggcttgggcccgactaacatggtaatagacctgaatgcataatgagttcttactttgctatcatcaaaagacttttcatcacagttacatactttctaatttatggaaaaacagcatttggaaaacaaatgttttgtttttatttttttaaagatttaaaaaataaatcaactagggactaggaatcaacaactgtgagtgagttaaactgtgttgaaatactaaagggttgtgaaagattagtgacaaagaagaacaaaagtctaaacctgtttattcctgtctatttcccacagaaagaatgagcaataaatggtacctcatataaattaataaataagaaggcctttctttttaaccaagggggtagatgtctacctttgtttgctttactaattaggtgagctcttttgattattattattaattatatttttggttcatatctctaatttctttatataatgggaattgctaaacttgactaatctactgtatacttataaatcagtcaaaattcatttacttttcagtagcaagaattacctccgtgactccggactcttattataagcctaccctataataaagaatgttaatctattcctattaaagtgttactttgagaaaaggaattctttcccacaagatcagtactcatttacttgaaatacattattttttataggaacaaacatttagtgagtactctggcaagtgaattaaacgaaggatgacatatcggctagttttctttatcacaaccgccagtgccatcatcatcatcatctaatgttttctgagcacctactatgtgctggacttttcttattcatcagcaaagacatttcttatacttccatgttatttggttgaaatctgagtcttaagaaagccaagtttaaaatattaactgagttttgctggaacccagcatataatacatgctgaataaatgtttgttaaatcatgagagaatgatgaatatattaatgttgataacaataatagtaatgacaataatggccaacattttggtatactcatgcttaatatatgtcatctcacttatccttgaaaacaacctattgttaggtcctattgttatcattcctgttttacatatgcagacactgaaactcagagaggttatttgttttccccaaatcacacagttgacaataaagacctgggatttgaaccccaaatttatcggacttcaaagtttatatccttgataaaaatagagaacccatgaatttgggtgacagccatcctttacaaagacatatcaagctgcttctttgctcaatatatttaaaaatagaacagaatctttcctttcagtgttggttggcacggaggtagagttagctggtgagccgagacggctgtaggttctgcctatggctgagattttgtaatacctctggagattaagtgggttttagaagaatgcttaaggtagtagagtttggactggggagacagaacaaggtggagggaacactgaaggttgtggttagttctactttcccaggcttctcagccgggtcttagaaagttcatgtgaggacttggccagttagaactggtaaattgaacattcctcactcagtacacttgtcaagttacaggcccattctaagtcatgctgcattaaataaacaatgctttaaaaaatgtccatctccatagacctcttatctaaaaatcacctatttcatatcaggtgaatgccatgcattttgtagaggctagagaataacttagcggtaggggagatggcataggagtcaatgcctctctggtgggctactttaaaaaaaatacaactttctccataacttttatgtccctatattttgtgttgtggtatttgtgagaggtactttgcatttataccttcaggagacttggttcagcatctagttaattatctacatgtaggtgcttaatatatgccatgccaccctttttgtctccctgtatcatattctatgctaataaaattattttcagcactctaaaacagaagttcatttaatttagtctctcattaggtcattttaaaccaatgattctcaaccaaaggcgattttggtccccgccccacaccccaattcacgggacatttgacaatatctggaggcatgtttggttgttatccctggggacaaggggatgctacgagcatttattgagtagagactagagacaaggaatgctgctaaacatccaacagcctacaggacagctcccaccacaaaaaatgattcagcctccaatgaaaaaagcactgaggttgaaaaaccctgcttttaaataaagtcacaggcttcccctttataaattactaatgattaattggtcagatttctgagagaagacatagtaagctactggatataaagaatgagaagtcgtataacgatatcgggatgcctggggctccaggactaatatgtcaggtatcctcttagtgtcagagggcaaaagtgactgtttaggtaagttcccataacagttttctctgatgtcacaaagcccattctttatcgaggcaaagggtaaagtcatatgtggcaatgcccttaccaacagcagcagcttcaggagtatttgcatggcatgaggacacctccactctttgccctctagtgttaaactcaggcatcttttctgtaatgtgaaaggaaagcgtgttttcagcacaggtgacattctaaaattgggtcttccctgtgaagaaggttcgtatgaaaccagataactctttcatggccacaggtttgtgttgcttctaccaaagcagcatttcagggaagtgccttcccagggccggccactcacagtggacttttcacctgcactcaccttcttccaatttgcaaagccctgcctcatcacatttgagaaggccttgtacttgagtaagttaaacagtcacgggctctgctgtctctgatctgacaataacaagcattatctactttggattcccagaataaaatcaggcactgagtagttaaatgcttttccctgactcaagtagcacgtcaatgacaccactggaaactggccatcgactgaattctcatcaaagcagaaagtgggatttagggatatataatagagtggcagagtcttaaaatgttgagagtaaattatgtatctcttctttttgtttcttccatatgtttgaatctaagtttaatttttatttaacatcacaaacttaataatgataaaaaatgaagctgaatgtcacaatttgagaaagggaattctgggtggtggcagaggggtagcaacatgcaatagcacatgttggttgagtaactggacacgcaaacaatgttctctgcttacgcaacctgtgtttggatgtgtaaatgcaggtgaccaggtacgattcagaagccactttaaaaaacaaagcaaaaggctcagaggtaacagcctccagtgaatctgatccatgtgtaaggaaaacaggatgcgtccctggaccggctggtagcaagatttatgtttcagaatattgcaacataacttccttccctctgttgcctttgtgcattgtttgaaggaggagaataaaggactacttttgcagcacagcagtctgtaaagatggatggcatggggttagtttaaatagcatattggcctttctgggtcactgtgggcaaccttgtccctggtttattttaacacctgctttaatgcctccatgatacaactgaatgggcatctttcattcattcgtctgttacttctgaatgaagctacttggggttcgttagaatgatggcaagtgagaatgcagtcgtctctaggtcattacttgtaatacgttctgaggactgcctttgctgatggggggagaaggactctcacagctgtagccagcgttcatgtttggtcattgctggaactctcaggaagcctgaaactgtgaactttgtagcagaaaagggtgagtggtggttttgtatttgtgtgtaaattatcctgctatatgcaatcaaggaaatgaatgtggacgctttcaaggctacttggttattctagtgggaatatagatactttacttttcttcatttggctttcagttatattctaaattttgcaaaaatggacatatattatgtacctatcaaaaagttaaaaataacaaatattggcagttcaacagaccatgagcatttgaggagtagggaatctgcctgtcttgttcactgacatttttctagatattttctcagaaaatagcagaaagtaagaactcaacaaatacttgttgcataatgagtgagttgatcttcatgtgtttattgatagaatgaactgcgttaggtaatgtgaagattatatacaaagcacaaaagaaggcctgtgtcctaaaggactttaaatctagtttgggaggcaaaatgaacaaatgtaaaacaattaggaaaccatgcaaggctgtgtatacaaatatacaagtatatgcatatgtttttagttcttagcaattcgaaaacaatacaagactgtatattcatgtatatgtatatatgtgtatgtacctacataggattatatatatatttgcaatttgcaaacattgcgagctcgtgtatgcatatatgcatgcatatatatgtgtgtgtatgtatgtgtatttctagctgaggagataaacagcaagaataaattcacaaagccttgtaagagaagagcagagcgttttcatagacgggatgtggaggtgagcttggtttactcaaagtaaaatacatattaatgggaacgtggcagtagtgggagtaagtttggatgtaaggtaggtacaaaattacggtgggtcatgagaacccagttggaaatgtttagagtctgtttagaaagtaggatgtcattgaagattttttagcagatcaacataatggaggtggtatttaagagtgataatgctgacagtcgtaagaggtgtaggcaagtaggaaatacggaaaatcagacagcaggcagtgctgcattccaaacccaatgtgatacaggtacagggaagggacaaggtgatagcagagggggtggcattcagggaacagattcaaagtaccttgaaggaaaattccatcagccctgataactctgagttcggatagagagagaggtggtaaggaatgctaactcaaagatattccaaagagaagcagaacctcgtggatatcgttcctggttaagtttctgctcacctttaggagctgaagtactttcctagactcgtgagtcattttacaaaggggccctctatctttccactgcctcagggacagaacatatttaacccaatccacaaatttacgtggtgtctgctttttttcacttgtctccttggaggaaatcctgcagccttccatggtaatgaattcctgcttctgactgtgcctgtggtcagacagacttttctatgaatggcaaacctcctggaattttaacaaaacaaatagacaagaaaaaaagaatgcatgtatatacaacctcaccttaatttaatcattggaagaataaattcttttttgttatgtgggaggactgaattaatttacaataatcacttttataagatttctgggatttccaatttgcaatcaataaatgtttgtcatttaaattaaatttacggcccacagccagatttttgccacacttggtaatgacacttacagagaacatagacttcaagtaagaaaataatagccatttaagtggagagataattggctgtaacataagaacattgaagaatgttgaaactcatggagacttatggagtattttaaaaatttatgttgtacttatctttgcatttgtagtctaccacaaaattccaaattctgggtataaatcagttagatgttcatcttggagagtcataaatcaggaagcaacaatctgacccagcctgtgtgctgctttattttcagcctctcctgtcggcttatcttgcagggagactaaatagtgttgttcgtttgtgtgtgtgtgtgttcatctacacacctcatttaagcactgtggttttagacttctcggcttgataacatctggcttatcttgggaacatctggtttatcaccctatttcttccctgccattatgctgaccactggaaaaatatggctcaggagttctgacccacagggctctgtctcttggtatcaacccctgctaataaatagcaactcacaggatgcaggttacgtgaccatctttcactggcactaactttcctgctggtggcttttgttaatggaaggtgtggctaggagagatgaaattggctgctttttttttttttttttatggacgttgattcggttcttagccatttgcagtttgcaaagtgagaatgtgtatgtttcattaggcacaaggatttcagaaagtgctattttgtattttgggataggagaaaccaatgatttcatgtcagatactctaggcactccagaaagtaaactgggacattttatgggcttattgtaggtttttccaacctcccggagtctcaactggctcatcaaagttactctgcctggatatctttggggccaaaatagtggagacccaaattcacaaggaggaaatcttggagcagaatcaggaaaaagtggctcattgcttcttagatttacttcaaagataatagtgtaggtgaaagtaatcacaaggttcagggtgctgcattggacaaactgtctatttgtatagcaaccatgtgtctgtgtggagaccttatacacttgctgtgtttatttgtccatgccccactatctctacgccaggtcctggaagcacagcccagcagatgactcacctctggatggaatcaacacacaaagcagataaaaagctgaacattaaagaccacattgttaaagcagagagccaaattgttcctccaccattccctatcccagacttcacatctaacaaggttaatttgtccctataattatgtgcctattctttgagtaatgaaaaattttattgtgggttttataaaatgaattgcctgtgatgtaaaacaatttcagtaagggccatttttttttcttcttcttaacctctcaggttccttttaactttttttttttttttttttttttttttgagatggagtctcgctctgtcgcccaggctggagtgcaatggcaagatctcagctcactgcaacctccccctcctgggttcacgccattctcctgcctcagcctccctagtagctgggactacaggcgactgctacaacgcccaactaattttttttttttttttttttttttttttgtatttttagtagagacggggtttccccgtgttagccaggatggtctcaatctcctgacctcgtgattcgcctgcctcggcctcccaaaatgctgggattacaggcgtgagccactgcacccggcctccttttaacttttaagactgtgcgctcagaggtacgtttgaaagcaaggcagcatcctatgctttactgtagctagaatgagagcagggaaaaggggagagagatccacaatgaaatacacactcttattcttggcaatggcagagttgtttgaagctaaatgacttcttatccattaagccatttgtcccaaagtgatgatagaagatacttttgtgccttttcttttccaaaatgatggagtgatttgcacagtttcagattctaaacactaatattttgtagacctgcccatctccattactactgcaagttattcattcaaggtttgcagccagatggattaatgaattaccagatcttgcataaaatgacttggcctgacttaaacaactacttttttttttctttctccttttctttttttgggggttagggtggggagcagtcttacaatgggtgttaatgggctgtagagggagtgagcccccattgagtttttttaaactagcttttttaaagcttcactgcactttttcattcttttctgaacttctgctcagaaaccgtcagttcaaggaggagcaatcaggctggtagggcagagaggaggaaggagactcagtagtcaaatccctggtggccgatgcccttccctgcgccaaatcagcatgatttatcagagccctctcttcagcacagagttgagagtgagttccagggtcctcctcacacaatatgcatagctggagctctgaactttgaaggaaagcctcagagctatttgcaaaatgctggtgcttagtgaatactaaattacatttaggaaatagtctactgctaccagttatacttcatttttattcttgacacagacacctaaatcagagaacagtaacatttcagagattatggaagcagtttgggtatgctccagcactataataggatcagaattttaaggccttttgtattattaccaatagtcacttagtttctactgcagtgtactttgtagggaattacagcttttactaaaaagattaaaatgctattatgcaaatgattgcagtatgttattatgtttacaaattaacatccatggctcaacacacaaattaactaactatgctatctgtgttattaaggatttaataaagtaactgttaataaaaatgggtagcttggaactttagtagaaagcaattgtgatttaacacgtggaacttgagcattgtgtttaatgttctaggtgatataatggtaaaataaagttgaaaaaagcacatagaaaaaccaaaactgtgtgaacagcagagctgcttgcctgagaggctgatgaacgtgaactaaatagcttcaagctacaatgtacagtgggcagcatagcaataaatctaagcaaagcacacaaaacatcttctattaataaatagttcattgaaatgataattaccctccattacgtgtttgatatgttccatacacacagagaatacttatattattctaaaatggatctcagagcaaattttgctgtggcgaatgggatttagctgaagaatatcgctgggtgataaaagagaagaaggctgggttcagactaagatggctttacaaacaggctgcaaattgctattccgggctgttcataagagatcataaaagcaaggagataagagccgccaaggtccctgagaaatgaatgtatgtgattatgttatctcgtaggttggatttactagacagaccgacaacaccttcactttagcccaacaggaaaagtagaaagagatacaggtttggataacaaactttgttagaataggaaattccaaaacactgtaattcaaatgtttcagaagagagccaggattccagtcactgacttctgtgctggatctcaaaaaaagagctagggatatgacctaatattaagcaaataaacaaaaaagaaacaaaagaattacaagaacatcctggagaactaattctatatttcaaatattttggactgatgtttcttaattctcaaataaagatgttgaggacttctaagtccacaaacaattatctttttaggtctccctattgagggatactaacttgaacttcttagtaggaatatctggatgtgcttaagaaatgtacaagcagggaagacaccgcaaagttggtcaaggtttgtacccttgcatacaatacaagcaatttattttgttccaaatagcacctctgtggttgcaaaactacttatgcaaatttttgatatctagctttagcaaggtgcctggttccttcatttcatcccacatttggataaattgtgttgttcttcactcttccaaatttgtccttgtggaagcgaacacttgtaaattggttgaagcttgctaagagaaagaaagggaggaggtagggaagaggaggaaaaaacttgaccaaaagcagttgctgtgacagcttatgatttgatggtttgtggtcttgtcctgttctcaagcacctgatcaagaaagtggtacaatcctgctatgcagacattctggaaatcttgccaacattcacctgacatgaccaaggtttaaagtccttgctgtaattttacaaagcgtagtgagagtgtgtgcctgtgtatgtgcatatacactctctcatatcctttttttttttttagggggaaaaaagtgatctttgccatagaagggtggtaaaataattagtccaatagacaaatgtcttggcccatgtttaaacagagctttaaggacacagtgttcccaagagtcacatatctaaatacaaaccagtgtcagctgccatgcagaccaaaatgtaatagcctgctttcacataggtcatcgtcaatccattttggtcgcagtcacactgcacatctgtttctgcgagctgcagcttcttaaggtggcatttggacttcatcagaacacaaacaaccaagctataaattgccacttctggagttactttgaataagtgtatactgtttcatatttataatggtgaagcttcataatattcacagtgaatatgtaacaccgatcagttcaacaagcatgaaattgtatgttgtcaacctgtcacataaatagagtcatattctggcttgcgataatgttgaactaacattttttcccccagaattgttgagaggttcacagaaaagtgaggaggtagcatttcctttgggtagataaccagtcaaggctattgtaaagttgatattactgttgatgggttccttttctcccctccctccaaagcactagcttttctcgggtgaatgctaattggctaatctggtgtgtttctgctgtcatctaacggtatcattttcagctagtacttggaggctctttttgggttgtgtatgtgtgagtagctttttttcccctttaaaacttctttttttttctttctattcttgtagtgcaaatcagtgctaattgtcatgaaattctctaactatactctggcaagctttcttgttgccttttcaccccagttaactcttaatgtattactagagcattaggaaataatgaaagctggacattttattcaaacttagttgagatagagaatcatctaaagagatgcagaaaaaaattattgaaccaaatttgcaccttactaaaaagataaaggatgaatgaaatgtgcttgccggtagctacggagaaactcagagaccagtttccacagtggctgatatttctgcaccagaggcatggtagaaactgatgcaagtctgttttcacttttgagaaattcttagatgtgttcaaccttcctcatctttcttccaatggcctgaagacaaaaaggcattgcaatctgtattacccgcttaagctgctaacttcaacaccttgagatagtacttcagtttctctaaagcactatgcaatattacaggggattattaccaacacttttcttttcatcccatatcacttgggatatggctggtcacatttttttctttattttttattttttattttttatttttgagacggagtctcgctctgtcgccccggctggagtgcagaggcacaatcttggctcactgcaagctctgcctcctgggttcatgccattcttctgcctcagcctcctgagtgagtagctgggactacaggtgcctgccaccatgactggctaattttttttttgtatttttagtagagacggggtttcaccgtgttagccaggatggtctctatctcctgacctcgtgatccgcccacctcggcctcccgaagtgcgggattacaggtgtgagccactgcacccggcccacattttcttagacaagaaccaattcactggctaaagctctcagtttccaacttttgcaacatcgtcacatttcttcttgcctgtggattttaaaagttcatctctcacttatttacttacccattcatcaaaatataattgtcatccattagcatgcttagtgtctggccattttagggggatacagtggttaaaagtaaacctagtctctggctccatgaaaattttggttagtgatgaagacaggccttttacaaataagataagctgtctgtttgaggaagtagagcagggaatttctccatctgtctgttacccagttatcactagcagataaattctgcccttctcctacttattgtctttagaaatgccttcaccttgaaatggaattctgctggagagcatttctcctagctagaggaatattctattccaaaccaagatctgtcccactgccccaacaaatgcagggcagtgggacagaatatttgaggttggaagacctgaaatttatgatgtcctacacacagtatattaaaataacagtttgctcattggaagtgctgggtggccagggagtgtggagggaaaacaagaggaagccaaccaagggaagagagcaagaccgtcagtggagagttctttaaccagtgtgcaagtctgacctgaccagagtgctgtgcccttggtggggcttctatggatgagaactgtttggtaccattttaggtctgttgacctttctatttgagaatggtatttcagtccagctggaaggactgacacgctttttgcctgtttgagacacttggtgtatgtggcttttctctctctctcttggatccatcatctctaagtgatagctccttgcttcatggggtaatgctattcaggggctatcctgcacccttgggagaggcatgtgcaggaagaatgctaccgatccctttcctcttccctctggaggtaccaggcattacatccctaccaagccttactcaattaggtctctttcagattcctataatactcgagcttaaatcctcttctccacagttctttctgagaaatttatttctgctttgaaacggctcttgtataggggaaaagtgcctctattatagcactgcccttggtttttccatgggctcttggcttaaggacattagcttccctgggtgccatctcatttgctcagatgtgaagttagagcttctgtattccagacatagttctcctgggtgtccagggatccttgccaacccagattctctccagatatgttcccatgtcagaatcctcttgtgtcttgccagcccatacttagcggggacaccctgctctctcctctgagctgcatatctcagcatgcatttttcatttaggcaatgctgtctgataggcaggttcacctcctattcccactggagaagagtctgggcaaatgcctgaaagtttgaacacagcaatgccatataggataagtgacttcttttccttgctggtccccaattccagggctctgcgtgcaacagatttgagagttacattaggtcacaatgccactgtctagctcctttaatcctatcaccggcaatcccagcaatgtagctgaggtggctgcccctgtcctgaaggactttgtgtcagtttctcctgggacaaatctagtctggaccactttgcaacatttgttcaaactgaaaattttgacaaagacattctgttcacaaagagccaacaaatgttctgtgtttcgatacatttggaggttacaaaatgttgcctggtcttggcagataactaagtctggggacccacatagtgcaagccatgccctgtttaatttgtctttcaatggcaaatgtgtttcttctgtgattcagcataagggatgataccctccaataggactgtgtgacctccctgctgcttttgtggtatagaaaagaaaaaaaaaaaaaaacacggataccacttttttcctttagttgctggtttatttttatttccagctacatcttttatagttgaaagagaagatgtatgttccatagatagtacgcatttttatggttatttttataattcatactggaaaacctaatttctgtagccattaaaaatttaggattattaattgtctgaaacataggtgagaagtacactgtttttaaaatgtctctgagaagccaaactagattcagaaaaattccctcagatggagcacattttattcccagatacacttcttcacccctcacttaacgcttgcttccttttgctttacttatgatttaaatgaatccggttgtctaatgttctattcaatatgtgatgttctatgagcacatatgacatttgaagaaatggtttagaaaattcatgaaatggtgacagtaaaaagataatggtgagcagtgacaactgaccaaaagagacaagactacaaactacagaaagttgacaaaccctgaaaatatgacagtctggggccttttagtttgagggaaaataatcctatatttctcaataggtccatacagtcattttgcaataccagacagtgctaccaaaatcaatcctcataatttttaaagtggggaaaatatgtaaatacgtgattcggaaatctttccataaaaaagttttaataaaaagtttggtgcttaagcaagttaagttctttgatttatctgcaccagtgcctatgtggattaaagcctgatcatgtgaggaaataggtgaggcatatatacaaacacaaacacgtagttttagatctaacagattttaatggagtttatatattatcctgtaagtgtttcctgtgtagactttgataataaagaagaaaatgctccatgaaataccgaacttcattttataatctgttagattacatcttcccttaaaaatacagctattgaaattttcttgaataaagagaccactggattctttttccttatcaatagtaaagctttttggctacagggacgttggtcaagacaaatatagctcagtagagttatcgttaagtaagcaatttcccacattactttagaatgaaatcgcctatacttttctccttcatggctttccgtatttatcctacccagtcctcaaataagccaccaccccagcaatgcacaactcacttgtaaatattcatctggagcatacgaaatcgtaatatcactacagagactaactgcccccccgcccaccccgccgtgccattttcctttggagactcttataaataaatgaacaaccttagagctttcaaaacagtcattaagatctgctacttgcctttggataaagaatttcagataatgtacaggactgggcttcctaaatctaatttctgtctaaaaacctagggaatgctgtagctgtatcttctctatccaaactctcttgactgattctggcacctttcacctgagaatgcacagctcaagattctctatacggacccagagccttggtcgggccacaacccttcattaatattcaaactttggcagtttcaaagaatgctgccctcctcgaccactgtgagcagtccagctcccctgctactttctctcatgcttatcctttgtacgaagacatctgtgtctttcctcatgtctctttcaggagtaattcttccccttgttcaattttttcctttctctttatggctgtcgtaatagcccctgatacagccaggcagccatgaccctgtccatcactcacctgcaagctattcttgaaccactggatggtccctgagtgactagattaatggtgccagtggtgagccttttcacctgacctttcatccagtgacatacaagctgattccaggctgtgtgcaaggctggctgccctgccatctctgcaccctccatgaaaccaagcagtggaaaggagagtatccatgcaaattaagtgcagaagcagggataaaataaggtgtgcagttgggagttatcagaaattaaatctgtcttcctttgagtgccattggaaatgagtcttaaggaatgagaactgaaaggaaactttccatagacaccatttccataaacggtattgtcacaatatgctattttaaagactggttgttttggtctgtgtttacattaagcctttaccaggcatgggataaactattaagtcccgaaatttaggaaagtatttgtggccgtctttggcacaaagtgaatttttgttgtcacatgtgcaaaagagcatctttttctttcgttaaggccttcgaattgtggttcagctttctaagtaatagctttttggctaaatctctcaaggtgcattataaactgcatgagggaaagagggacctcatcacctcctcagtccctagcacaaagctgtgcacattaaaactctctctagtttttgttaatggacagatttacaggggctctaccaaattcagaaagagagagagaatataacatgaccttcccagccattcagaccaatcatgctaaaaataagacatatccaagatctgagaacatgttctccaagagatggtttataaacagagccaatagtgacagcagtatgctgtgtgtctgccagagtgtctgtgaacttaccccctaactcagctacaagacttgctgttcagatgaagatatatggagttgggagacatgtggttgtgttaagcgaatgtgcattggcgggtaaaggcgctgctatatgtctactgaagacatagagcatttactcttctctccccgagaagaggaaagggctctgccactcaatgaagagctcaggaacaggtaccttaccggggttccagagcatgaaagtaagtgtgtctctgttcaaggaacccgctgttcccaggaagctcatgcaaatgcatggccacagcttcccaacacgctgttcccagcactgtgcccgtatttcctggctggttttgaccctctcaatggattcagacttaaaatttttgcaactgtttttgtcgttgttgttgttgtagtttcctcgtttacgattgtaatgaaaacagtttacctcttgtggaaaagtgtgcatgattgtacaagtttactgtgccatacttgtatcgcagttgccttatttttggaagaatcaagcttaggggctagaaagaaatcctgggctggggaatgatgggtaatttctcaaggcattcagatctttcagaagttgtgaatgattctgaccttactttcatttatagtctgtgatcattggaaccaggatgcaaaaatagcagagagaggatctccttcaccttaattccctgcccttttctggtatctgtagtacaattgactatatggacatcactgctattttagcaaaagctggtgagttatcttttttagacgggacagtctacccagtccaggattttagtctgactgtcatgttataattcagtatgttcctatgcaggatgctctaatgcagagactgatttcattcattcttaaactgacccatttatcaactattttaaaaagcaacaactacatgctaggcactaatttaagtgcgcataatacaaagatgtattaagtacataatgcctacgacacagaattttcccttcaggagttggttggctagtgagaaagacagacttcggcaactaattataaaataaggggatgcattctgtattaaagtcagaaatgaagtaccatgaagacacacatagaggagtaaaaatgtccgtgaaaagggtgagaagagaggaaatttgataattgttgctagatttttttactcgtgagtcttcaataagtcagaagttaaataccctcttatttatttataaaatttagcaaactgcacttcccacctcttaggaggaagacaagaaaaaggatacacatagtaggttcttaataacatttgaaaataaatttgccttctaacaagtcccgtctacattgcactccgcagttcaatggctcattaggttttaacaaaagcagcgcagcaaaataagaaggattcttgagtcaagcacccccgggcggtatctctgagagcaaatgtgacaaatagaatcagaaatgaattaaatagtcagctacagcaagccaagctaaaaaaaaaagctctgaaatgacccaaaatggaaacgtattacagttatctgcattcacagtaccgaacaagtttggtcgtatttaagataattctctagtgcctgctatttttagctcaagggtaagctcctgtaagagtctttcggcattgcatccctttaacctggcctaacaaactaagccaataagctgtctgattttcctggtccatcagggaggaagagagatagctaaaacaaaccatttgcggggaaaatgttcggcctatcttgtgttaagagcttttttcatatagatttttaaaacatcccaatattaagtgttgcctgtcagagaccaaaatgtcaagctttgctgttttgaaattggaggctcatggttataaaaagaggattttataggcctagtctaatggaaataaacattactccattaccttcagtaaaaccaaatctttacagttcaagctatcattattaatgtctatgagaagaaagaaatgtttctagggctttatttattttttttaggtaaagaaaggcgagctgtaccatagcaaatgaaagttttcttaaagctttctcctcagtgactttgcagtgtgtaatttaaaagcagaaagcaaagaaaatgcagttttaaaacactaggctggctattcctggtatctttctttcttacatattcacaactctttgtgagcctattgctctgtcaattcttgtctgtctgtctctatatagtgtatacaaacaacttcatcaactattattcaccaccttctaagtgcacatgtacatgtgtgcgtgtgtgtgtgtgtgtgtaggaataaatgtgggctgtctcagtttaagccatataactgcatgtgtagattacaacacttaacaatatactagtttccactcatttcatcagaaaccatgctgctgatcatcaaagtttaagactgttctcaggttgaccagtttacctacattctgaagcctgcatttgccaatttagtgtgaaatagatttcagccgcagatgctacctgtgaggcaattaatcgccagatatttcttgagttcatattattatgtgcaaggtgttatgccaggtgcggtaagaggtggaaaggtgtctaacacaaggcctcagtcctcaaggagacttgtcactgaactgcagaaatgagatacccatgttgatagaatgccacccaaggaaattttaagacatttatagagtccctactgtgtcccagacaccatgcatgggtcttctctcttaatagatctgattctacctgaattaccagccttctcataaacattttattggggccgtgctaagtgtcaatcactacccttggttatgtgtgatttctgtcttcccacagatgaggaacttaggacttagtatttaaccagaactcagatttcctggttcttactgcttctcctcagtgtcagagaagaaatgggtattttctatcaggaatcctcagaaacgctggccagtcacattgccatgttcaaggatatatttgcttgactgaggtggtccattgatggttgaaggatcaagctgtgactctttcttttcttttggaggcagtctcactctgttgcccacactggagtgcagtggtatgatcttggttcactacaacctccacctcccaggttcaagtgattctcctgcctcagcctcccgagtagctgggattacaggcgagcactaccatgcccagcaaattttttgtgtttttagtggagatggggtctcaccatgttgcccaggctggtctcaaactcctgagctcaggcaattcacccaccttggcctcccaaagtgctagggttacaggcgtgagcaaccgtgcctggccagtggtgcctcttttttgcagagaactgctggttgcaattgcaactgccgtctgctgtcaatgaggtctttggtgctttgcaagcttgctgctgatctttagtcccctttaagacgggctgttaatctttagcacaaggctgactctgcaatacagcacacaccaggttgcctaacttcttgtttatgtgctcccagggatcagaaaccagtttgctgtttccccctaaaaccacaagccttggggtcattgtctctatctgtcctttgttctccatgtacagtctgctgcgaaagactttcctcttgttcttgagtgcatgttcaccatcttcctccatcatttcctttgaaccctcagtaactcatacttaggtgatttagccttcctctcccctgccagggctggttgctgctactcctgaaggtatactaccccacacataccatacttgattgttaaaccaaacattatttttcagcatctgctgtgtacctagaattttgccggaaaccatgataattacagaccaagtatatgggcttgggattcccttcctttggggatgcccagctgtataaggaggcaagacttacccgggtgacacaatcagacaatgggtaaaatgtagatagtaaaatgtggacaaagccctgttctaggcaccatataaataaaagagacaatgaattagcccctgccttcagtgtccttaaaaactaaggaaacatgtgagcattggcctgatattaacaaactactctaagaattttagaggtgggaagagatctgtgaaacctatgagtgaagagggaagctaatgtggtggaggttgcctttgaaatagatcttcaaggctgggtccagtgactcacacctgtaatcccagcactttgggaggctgaggcaggtggatcacctgaggtcaagagttcgagaccagtctggccaacctagagaaaccctgtctgcactaaaaatacaaaaattagccaggcgtgatggcacgcgcccataatcccagctactgggaaagctgaggcaggagaatcacttgaacctgggaggcagaggttgcagtgagctgagattgcgccactgcactccagcctgggtgacagagctaaactctgtctcaaaaaacaacaacaaaaaagatacagatcttcaaggtgtagagagatttccatggacggagaggaaacgtgggcattttagacgtcggctttcatctcattattattttaacacatatttatcacctactatgtgcacggatttatgctagatgttggaataaaaaactgaacaggatagagacaatgctatgagcaacacagtagtggtgaggaaagaccaagtgatgactggggactcatctaatagagcagcagagaaagtagatacaagtgaatgggatcttggaattgtactaaattaacatgaggggagatttcatctagcatgctcatttcacaatggagaaactgaggcccaggcatgtgaagtgacttgcataaagaatatcaaggttaagtcaggaggagcagaaaaaaagacaatatggggtttgttagacaccagggactcttaaaagttatctggtggcatcagcgaagaaaggttatcttagagcttgcaaccaggggcctggtgaggaagctgttgaggttttcaggcttgaggtcatagagcttgaattagggggtgatggtgacaatgaaaggaaggaatgcatatggcagacttcccgaaggaaggatcaataaagattgttgtcatattaagtgataggttggatgttgtggtgaaaaaagggaggaaaaatggctgtggtttcaaccttgggtgatttggagaatttgggcttggttaacaaaaatgagagaatgagaagaggacatgtttcagggaaggcgcagagaggaatgtgatgcgcagattgtaaagcaggtggggcggctgctattggaaggaagtccatgaacaatatgcgacgatggagctctggagaagtcatggagtgcttgataaggaggggtgtcttcaagaacattgtttatttggcaaataaactggaggaaagatttaagggatccccttttgccccacatagtaaagatttttctcttgctttgagtttgataattcgccaggcttcttcttgccaataataataatactacagtagctttgggcttgcccagcactggactcaacatcttaagacaatgttaaaaacatagttttacagagtttaattaaaaaaataaaaactagtcttatctaattctcataatcaccatgatgggttgaaagtgttacctcattttacagtttggaaagtgaggcttaaataagtaacttgcccagggccaagttacagaaagtaaccagaagaactaatattacctaactccaacagtcaaattcgtaatcattcccttacactgcttcccaattaatacctctattgccaggcactacgcttctcatcccctcctactcccagcttctttcaaattttccaaatgcctggaattatttctgtcttcttgtttgcaattttctcaaattttaaaatcacaggaacctctcaaattcaggaagtgttccctgattaattccacctctacctaaacatctagcagagacttgacctgactttgtccaagtagattttgtattatttagtggagagatcagcatgaatctgttcagccacagactggtcaacagatcagttcatgccctactgaccacagagctgtagacacttccatttgcagaggcttgtacttaaaagcatatattagaattgtgaaactgggcactgtttgtgacattcttcatcctcactgtgtatgtggttgatactcgttgactgattgactaagatttttgctggcatttggttgagaaggaaggcaattaccaagtattgataatgcatcttaaacctagctttaaagtcttttattgaactcttgggcatgtcttcatactaaattcagtagaatatgcctgttagataagtctcctgagagacaactttagtgaggaatataactctttttaaaatgcaatggaatatatgtatatttccccaaataaacaatttcttacaaattgcacgtagctgtgatcattccccttcctttagtgggcagcaaatcatgttgcatttgtgttatgcattttttcagaaatattttgccttttttttgtttctggaccaaggagtcaaaccatgccccattcatctttttcttatatacaattccttgcacataataggagctcagtaaatatgtaacactgcatggtattctctcacctacattataagcagggataatggcttttatttcttttggttcctgtgttctcctagcaactccctggtttctagttcaacattatgtccataaaaggtactcagtagctggtgaatgaaggaatgaatgaatgacatttaacttgtgatcatctaaaccattactaaaccaaattggaaatatttttaggggactgggaaaattacctgggtaacatgagctgttgagcagcttctgggctgggtctggtgactgtatcaaaatcttcagatacgtcagtaattccacttcagcatgttcattctttgtttcgaataatacaggtttttgtgcattgatgtttaagataaagtggtgcctattttgcatttctagttatgtttacaaaacagtgttttattgctgtctaaacatgagagtgctctcaaccactcccactgcagcacattgagaaagggctgttaggagtctttgcccttagtttgaaatatgttgtacttagaggtcgtagtgttctggtttgggtagcaaattattgatcagggtattatggtaacagctgtactgctgattggatgaagataaatatccaagcatgcaactggtattacctgacattattgtttttcctgggagcctagtcatcccaagggggttttataagaatggtcagaaggtaaatattaccaagagtctagtaggcagagtgcaagccagtggtacccaattctctccattcaccactatttgaattctggcccttgtgttttcctgcattcatcttttgactctttatttagatttccttgactttttagaatttttcttttgttccttgcttctttggcttcttgctgaggtatttattttttgaaggattatcaggaaacaatagcattgcttgtaatctctctgccattgagtttagtggtgcttcctctgctgttatcagagacttattttaaatagcattatttgttactgtatatatttaagatatagaacattatgttttgatttacaaacacatagtgatgattaccgtagccaagcaaatgaacacatccatcacctcacatagttacttttttttgtagtaagagcacctaaaatctactctcagaatccagtacaatattactaaccatagtcctcatgtggtacattagatctctagacatatccatcccacataattgcaatttgtacactttgacctttatctttccataccttcccctccccccacccctggtaaccatcattctactcgtttattttttgtttttaaggtagggtgtctcttgctctgttgcctgggctgggtgcagtgatgtgatcattgcttactgcagcctcaaactcctgggctcaagcagtcctcccatctcagccttccatatagctaggactacaggtgcgtgccaccacacttggctaatttttaaattttttgtaaagacaaggtcttactatgttggccaggctgctgttgaactcctggcctcaatcaatcctcccatgtagagttcccaaagcactgagattgtagggttgagctactatgccccaccttctactcaaagatttcttaattgtctaactcaaaagccctttttcaggtccccattcttcttgaattttctgtgctacttgaatattccttattgaccaggctacatgaaaattctttctcttttttggtgttattttattttattttattttattttattttattttattttattttattttattttattttattttattttattttgagacggtgtcttgcactctctcccaggctggagtgcagtggtgccatctcggctcactgcaagctccacctcccaggttcctgccattgtcttgcctcagcctcccgagtagctgggattacaggcgcccgccaccacgctgggctaattttttgtatttttactagaaacgaggtttcactgtgttagccaggatggtctcgatctcctgaccttgtgatccacccacctcgacctcccaaagtactgggattacaggcgtgagccaccgtggtgttacattttaaatattttgaatttttgttaatgttcttctttgcagtctcccaatttccttccctcttctttgaatacatcttctctccttcctttgctggaagaccctaaatgtacctgtaccttccccttacactttcagcattcaggccaactagagataattggacaagccaaagatcatgtctgacatggctcgctagtggctctgtgtctgaatgggttggcatcatctttaagaatcttgtcttggcctaacttgggactgacattttaagcattaaaactcttcactaattaacagaggcaacctaaagaatagtttttgaaatgatgcttgagtgttctcttactacattccctgggaatattccctggaaagcccacagagttgataatgtatttgaatcatgtactggaatgggctagtattaaaagttattacaatactattttaatttatatttataaacttatttatttgtattatataaatttatatttacatactttaatttatgtttatatttaatttattctacaaaatataaatataaatttacactttaaatctatataatttatatttatataagtatatatttatataccttaatttgtatttatatttcaactcagccagtccataaaacttgtagttatttttcctgtctttctaaaaaggctaaaaggcaaatgttctgcagtatggaactgagtctccgagttaagaggtttgccaggtaattgctagcaatgacaaaggtgagatttgactgtcaattttctacctttctgaacattagacagacttccaatattcacatatcatctctatgtggcattttccaggactttcttaggtcttcaaaaaccaaatgagggacatatctctacttcacaatgaggaaaccaggacttaaaggggcttgcccaaattccctgaggtcagcaaccttctcttctctttgtatcccaagaacctaaaggcaatggtagcaagatggttaggagactgggccctgtagtcagacatgcctgcctttcaaatcttagctctaccactgacttgcagtaggaccatgattatcttttttctccttttgtaaaatagtgcctgcctcagggttatttattcattcagcaaacatttactgatcacctatcatgtgtgaaaatgttctaggaatatagtagtgaaccagggagtaaaaaaaatcctgccctcctggagcttatgttctagttggttgttgttaaaattaaatgagacaatgcattgaaaatgtcctgtatagtgcctggaatagagggggtatgcattttgacagaattaagacaaagtctacaaactcctggaagtaatagcttttgcctttccttgaatctataaagatagcaaatgtaatattaataagtcctttacttttccaagaaccatttcattccacggaaagccatagtagtatttagccatagtagttgtttttataatttagccatagtagttgtttttataatttagagttctttggttgcaaacaatggaatagaaaacaaagaatcaactctagcttcctcaagcagaaaggcagaaggatatgtatggctgatggaattgatgagagggtgttgaactaggcttagtacctaaaagacctggagcctgggaactaaactgcaagaggagtctcatcacgattcaaatgtcaataggttttccctattctgtgctagccctggagtggtgagaatagtgtgaggcttttgcttactggctctcggtgtgtatccagtcaaggagggataattctgtgaaaggaaagtgtggtgcatttacaaatctactgggcagtcaagaaacaaccagtgacagttctgaggtcttaaagctggatgagttatactgtcagcacaaagtgtttgacattaagtaaaagaatggggttcttgttcccaactaaacagtgggaattctaccacccagtggctatcctctgaaattccatgaattgaaactagtgcttatgatttagttaatatacatttatctgtatgcatatgcagataaatgtatatttatctatttagtacataaaatctatttagtacgtgcgtgtgtgtgtgtgtcacacacacacacgcacatactaaatagattttatgaaacttcatccctggctttatttgccaaaggcgagtcctccatcttgtggtttctgcatctctttggcatttgtcactatgcacttgttgccttttatattgtcacaggaatcccagaaacacctatagaacatcagtgatgagcatcttctgtgagtccagtggtgcactggctctgggaatatggagagacctgttacattaccttctataattacatgtatttgctattcctgagaaatcatttgtgtgtctctgccaggaaacattagcctttccattttttaagttttcaaataatatatgtagaaataatataaggaaagtacatagttcaatgcttgcacttaattgatagtcaataaatggcaatttgttgacattccaataccttgaacttcctggatagctctgtaaaacggaaagtgtccttgggaacaaaactgcacaagcatgctggtcaagattcaaattccagggagaaggtgttcaacagcctgcccctgggctctgtgccagcctctcggtgatgaagggagagtccggcttctgttattggctccccagtatgtattcaatgtgtacctttaatcaaaggtaaattccatgagggaggggccatgcctgttttataggccactgtatcttgcatgtagcagtttctagcacatgatatgcacccaagaaacatttgttggagaaatgaccaaattgggattctctctacagaggctaaagggaaatgactaagctacttgctgagtggctatcattagtgcataattttcaaaagcaatcatagaatgggcaagacgtttaatctctgtcatgaaatgtaacctttagagggaagacaagcaatcacaatgtgacttctccgagtgtcctgcagctttgagcatggcccgggcctctctctgatggggctgatgaaagccaacgaacaaaggcattttgtatgttaaaacaaaccacatttagtcaacagtgtttgcaatgactaatccctggtaagaaaacaccaagaagtggcctacacctcaaaaaatataagcacagagaattctttcttggaatactggctgcaaaagttcagcgtttggcatttgcaatgattgctgtttgattttctttatggttgtgttggcacattctggaaagtcaggaagctcaagtatatactgtgggagctctatggggtgggaataggagatatacaagctttgttttgtattataactattgcaacacatttccaaatgtcactttttgtccatggtgggagaacctggggatagttcaatgtcagatggtttcaagtgacataacactagtgcagtaatttatttattcaattattgtttattaagtgtctactatatgttgagtctggtgacactttggtttttctgtgtttaaattttattgtttcattctgatgtagcacatcccttcctgcatctctttgccagcctaattccttataacaatccagacttcccctcctacatcacttctcccaaaccaccaacacctggcaccctaccacagcttaggtgcctctgatgtgggccctgtagaagctttacattctcccaggatttctcaatctgcctgtttcttatttgtcctgtctctcccatgggatgagaagctatttaagggtctgggctgtggttgtcactaacccagtatcattacttaactcagtgtctgaaatatagtcggtgcttattaagcatatattaaatgcatgcagaatatggaattaaataaacctgaaattattttttggagtacattatacaatgcacaagagtaggcatttttagaagcatcgagcatagtaggtccttgcttgtcccaagagagcgttcagttagctaagtaatcctcatatatttgacaaatgctttctgaatgccaattatgttccagtttaccatctatttggaagtaaagataagtattttaaaatataactaacattaaaagtcttgagtggtaaaagccagattcaaataagacagtgaagggtcaggggttgcatgggtatattagtccagtctcactctgctgctaaagacatacctgagactgggtgatttacaaagaaaaagaggtttaatggactcacagctccatatggctggggaggcctcacaattgtggcaggaggtgaaaggcacatcctacatggcagcagacaagatagaaaatgagagccaagtgaaaggggtttccccttataaaaccatcgatctcatgagacttactcactaccatgagaacagtatcggggagtgcgcccccacgattcagttatgtcccactgggttcctcctacacacgtgggaattataggagctacaattcaagatgagatttggatggagacacagccaaatcatatcagtgggtgaggatatcacttaggctggtaaagtatttcaacctagtttatattggaaacaggcctttctttcccttccttcccctttttttctttatagcttctcattcatccatctgggatttacccggtgtctaccatattccaagcatcgtattagatacttggaatataaaaatgaatgacacactccaacctcaggaaatacacagcagtaaaaaaaaattttaaaggtgaatcttgcctttgaaccaaacagtttagtacagtgtttattttcagtataaaaactcatatttgtgggacaaggccatcttcatttatatagttcttattccttctctcaaattatgtttcttggccaagtctgtggaactgttggactgtatggcctctcagtcaagccagacacagctgagaggccatcggaaacttgtaggaatttccggtaattggataggaccataatcaaattttatatgaagtctggatgtgctgatgatgtgccttcatttcccaggtcagagggaaaatctggatgccttaatacacccaaaggttaggagaggccttttctgaaattgttttcaaagggatttccatgaccaaaataacataactatgctaaaaattctgtgacctgataagaaatcccttgcctggattcctggcaacattacttaaaactaaaaatgattctctcttctcagaactaacactcagtatcggactgacttatctgacacttgtcatgtacacatggccttgtgtcattagttgtattttcactgctcctgtctcactcccttgactagattataaactctttgaggctaataaaaataatacagacaatagctaatatttattgagggtttctatgtgccaggcagtattctaagcactttatacgtttcatttaatttttacaacaacctgtgaggcaggtattttatcattatcttccctgtgtatggggaactggtcccagacaagttcagtagcttgccctaggtccccaatcctagtaattgacagagctaggattcatgcccaggcagtctgactgtagaacctgtacccttgtttactttattgtttgtcttctctagatgtcttgtgctttactacatgctgacttgcatgtggaagatactccagaaattaaatcgttgttttatcagatagttttctaaatgtctcataatcctatcaagtttctgtctatccttctgggtaggagatataaggcagttgttattgtcttaatattcttggtgagagtataaaggataagggtttatttcaggtacagcaaagaattttctacagaaatccctcctcattatcaccactgaaaattcacagtgcctaagtgcttatcaggttcaaatatgatggaaacctgtcccatctccaaatttgagattcctcttgtacacatctaggacatttgagtacctcctcaaaatgtgtctcattgatctgaggtaacatagcagatgtaacttaggaagtctttattttcatttctttaacaagtaatagtcctttggaccattgtaatagaacacataaagtataatgaccctaagttaatgttgttttatgctttattttctgtaccatgtttctatcttacatgtctctcacttttccccctttaaaagatgttctagggagtgcctgccactaaaaactaacccctttctgtactttcctttaatcgaactatgaaattttgtgtatttaaaaattttgattgtattttgctttctataatgaaaaccttcttctaatatagaaaaccagtatcctaaatgctaaatgcttaattaaaaaaattcttttacaaatttcttatataaaaaggaaaacctgtgaaaggaaatctctcagctccagaatcaaattaacaaataattttgattggaattatttcatgcagaccatcctgttaacctgcaaaagacaaagtgcattatagtttttttttagggcagtgatgatgtagctggaagttgaaataattggtgtacaaatacatgtgcaaacacgcacacatgcatatgcctgtctgggtcatgtgtcttgtacatatctatttccctaaaggctgataaaaatgtgctcacgaaaagataaaaactaggctttatatggtaagtataaaacatggcatgatgctgtataatactttaaaagagttatgttggtgtgcttaaccaatatttcatgggagaagagaactcgaataggatcttaagctttaggatttctatgaagaaaaaaaaacggagaaaactattttatagtgaagataccaaaatgtggaggtagaaaaatgggggagggtggatttttaaaacgacaatcagaggagagtgactccagtgctcatgggaggtaggcaggaaagagaatgagtgatgtggccttgatggggagcaagtacaatgaagactgccatgaaaattctatgtcagggctgtaggggtggagacagtggaaatctgaggagagcagcctctctgtaaagtgatcagctcctcctcaaatcccagcttctctagatcttcagatttattttttaaaagcagaaatttcagatacaatttgcggttcaataactgttgttaagtaatctaataatgtttaaaaaccttttgtaggcaaaaccatgctcaccaaatgaaacgtatgtctggactggttcctcctgaagacctctagtttgaaacttgagctagaaagaatgaaataattctacattttaattcaaaatgttgtggtctgcctccttagtggggattaattgtaatggaacagaatatttatgccctgcatgatggggacaagtagaaaaatgtgctgaattgatggagaaaactagaacctggcttctgaaactcttggttgtggaccagcttgagcattacctggacgcttgttagagattcagaattttaagctataccctaaacttcctgaattagcatctgcatcttaacaacatcttcaggtgattcatatgcacattaatgttaaagaagcactggatgtagtatacttaatgttcttgttttaaaatagcttctgtaagacacagcatacagcaaaagtttgaagagagagcaaaatctcagagaatctttggtgtaactagtgaaacatgagacaataaaaaggttcactcttactgaagcttgaacagagcagttaatatggtaatgttgatatatttagtaatgcgttcacagtgttaagttttttgcaagaactggtgtgccaagcacaagactcaacacaggttatgcacatatttggtaatcagtaaattaccttagatagtaagtcagttgttgaatcctggacaactgataacatcatttgctttcacgtgttttttcaatattgtgctcagcctcaaatataaattgaatagagtgaccctttgatactctatgaaatcgactgcatttcctaagattctgtggtttcaattaccataaatttttgatattgggtccatagccattgcattgtcccagcataacaatatcttatcatcttatcattggttctgataatacagtctgcatcagcacaacatattgttactaatattgtatgtgtgtgagcatgtgtgtgtgtatgttcccagtcagaacatcatgtcaagtgcaggagcaatctgcagtttacctagattaaatcgaatcactatgtgtattgcaaaatgagaattatttttgttccagtgatgaaattgtgttctaggttgctagctggatcttgagtttgtgagatggataagtccattagtggttcctcactttattagcaacttaattgtcagaatgtaatgaaacttctgaactgcagcaactcattagaagcaatgaaacacatgacattttttctagaatattcagtgagctactttttcccccaaagagatcttgaaaataaaattaacaattaagtttaaatgtatacctataaaggtaaaacagttttgaattctgccctgaaaaatgttctggataagttagggtcactgaaaagaggggaaccagcatttgaattcctactcagacacatgtttaagtaacctttaatgagttacttagcttctttaaacctcagttttctcatacgtaaaaaggtgatttaatagttatttcaaactatcactatgaagataaaaggaagcggcgtgtggaaagggcttgacagtatccctagtgcacagcaagagcgtatcaatgaccgctattgtcactctttaattttcaacctagatattttaattctcctgcctttgccttgaaataagtttgattttatttcttcaaggccaaagatgtaatcattaaagatcatgtatcccactgtattttctactagaaacaaggctagaaagaaggctgtactttactgccatgcttgtactttatagaaattgttggtgtctaccaaagcaggagtttacttttagttccctggtagatcgtggttgttttcacttggcctttatgacaatattactctgagcactgtcacagaagctcaaagaaaattcttgcttctcttcttatgctttattttagcgacagctcccaaagatgatcttggcaatgtataagaagcagtacaagcattgcaagtggtgattaaacctttaacttatatttcaaagatagcattaggttggtgcaaatctaattgcagtttttgccattgaaagtgatgaccaaaaccacaattacttttgcaccaacctaattatttcctgaagcccgtagctcaaacaaacagtgtgatatgaaaagagtatttcatttccatcaaaaagcgaaaataaaattatggataattccattctccttctaactccctgttctgattttttcttttctttctcttcttattttcatttttgtctatttttttccttcattcaacatttaaataattatacgacattacagactaatgactgtaccgtgcagcgaggattctgtaaacatcatgaggacaggagcagtgtctgttagggccactgctgtgtcctcacatgcatgaaacacctgccctccaaaaaaaaaaaaaaattctaaatctacaaataaatacaagaaggaataaatgagtaaagccaaatgaaacaagactatgaccttcaaagagcttaaatatgtattatggccccttttctttttaaaaatattatccagaattaaagtaaaatgcttgctatatttactaaaggttctattctctctagtcttatttttatgtaagataaatccattttttcttcccttatcatcttcaaacacaataaacttttctttttcatctgtatcccctgtttatatttgctatgattcagtggtttttgattttttaaatgacagttttgtcctagttcagctattccaaattgaaggcaatatctgtgagcctttttatcagctatgcgatagtcaatttattatgtaagtagaaaggccatgtattcagggctaaagattgtgatatggctcatcttaggtaacagattaagttcacatggcatacggtttcctagcgttccttcttaagttatgttcttttattgccagcataacattttgaaaacaattttaaataacgaacatcattagaggaatagtaggaaatttttatctgatgtattacggtgctctttatgctcagtgtctcatttaatcctcaccacaattctatgaagcagatgtctccatttttttctttgagacggagtctcactctgtcgcccaggctggagtgcagtggggcaatctcggctcactgcaagctctgcctcccgggttcatgccattctcctgcctcagcctcccgagtagctgggagtacaggcgcccgctaccacgcccggctaaattttttgtattttcagtagagatggggtttcaccgtgttagccaggatggtcttgatctcctgacctcgtgatctgcccgcctcggcctcccaaagtgctgggattacagatgtctccatttttacgttgatagtactgggattccagggcccagatgccttcctcaaggacacaggcctgtatatgacagaattgtaacttgaaaccctttttttctaaggctaaatcccataagactttgagtctactactttggaaatattcacaatgggcataatattgataggaacagcagcaaaaaatgagaggtcctgagttaatgtttcaagaatattgaatgctcttccggggacaaattgagcagcaattgacgctgaaatggcactgaattattttgctatcaattgctaaagccttatgttttcatatcgtgtgcagatctattccagggccacctctagctgatagcatcagatctttcacccctgaagagattacagctggctaacattatcctcacaaacagacctggaaagtttgtctacaaccactgatgggagctcaggcaaagaggactctgggagagggttagctcgagggcatcatgatttctcttctgcttctgtggctttgctctagagtctcagaccaatgctgtcattgtttttatgccggttgttatagtctacttgctactgtgaggtgctgtgaggaagaaataaatttaagtcaagtttgtaactatataagcatggtacgaattcagtaaatattgcttgaatgattttatctgagaggcatgaatatttagcactacatttttatataatgctgcttaactcttccttaaagcacataatgatcatgctattttttatgtcctgtaaccttatgggacaactatggcagatttcacttctgcctttttacagatcaaaaaattaaggcccagggaagacaatttgaaagcagggccacaaagttgtgtagacctgggctgactttgattaattatttaatcacactttagctatttctcttcccattttctcatgtatggcatacacaaacacactctggggttctttatttttatatatttttaagaataaaatgctcattacagaaaactggaaaaagacaaattgacttaaagtcatctgaaatctcaccttcttgtaatattttgggattcattcttttaggctttttccagtatccatgcatagatcatggactgaacaagtgctatttgacaactgtcttgattcgtttcataatatttaatggctatgtttcattttaacaaaggtatacctatataattgttttaatgggtatcaagcatttcacagtatgagttccctggttttctttttatctttaaacccaggtactcattgcttacacagcctatggtcagaggtaactctaatgtgatctgtgattctttgtttttaaaggtgttcaatctgatggcagtagtcattgtaataagacttttggctggcgggtgttgccatcatacactaaagagatttcatgacttaagacatttcatggactcacaagtactgaaacagggtatgagtggtaatggaggagagaactgtgactcaggaaagaagactccttcggtcaaggggccagacttggtatgcactggacaaagataaaacatcatgttctgtggcacatgtgagggattctgggcatctcagtatgccacagctggttctcactgatgggcaagccttctccttcagcctacacattagatcataacaaatattctcacctttcctcaaagtttttattatttaatcttttacaggtgtgattcttagtcctggcttctattagaatctcacctgggaagatgttaaaactactaactcccacctccaaagatactgacttaattgctcaagggtgtagggaaggggcaagcatatttttttaaatgcatatgtgattaaatttaaagccaacattgagagtcactactttacaagcatctattactctgtaagagtcagaagaaaacctttatcccagtatgaaaccttttctaagaaaaaatatttgtgccctgtttttgtaaataagcctgatttttaaatctattttggctttacataaatacaaatagagttcttattgctttttcctttcatttatttctcacagttgtttattttgtttatagtaatttattttgtctatcatctctcttcccccaacagaataagctccttgaaggcaggaatttttaattattttgttcatcgctatatccccagtgtcaagagtgtccgacacatgctaggtgctcaaaaaattcttgtcaaaatttttgacactaattttgatgcacagatcatgattcctagtcccaggaagcttgtgatctattaaaaacacacagacatgaaaatacaatccagtatttctatggaggttaatgaattgtaatatatttacagtaggttaaacaatgttgagttttaaagaaagcatatggcaaatgtaagagacagagtctttgccacttatttccttttattctcctgataagcaacatggtataatagaaaaactaaggagccaatagttccaaaacagatgtagaattagatcagttaccagaggacattgagaaagtttgtttaaccctttggatgtcaggcttctcatctccaacatcatactgttggaagagttgaccacgcagcttttactattcagtgtttccatgttactacatcctatcgttataggagccacaatgtggcaaggcattaaatggcatgtttttccttttcatcgttctgtaaatcttacatttttatccagatccatttacacctgtcttgtcattttccatgctgttacagggacacgtgcttttttatcctgttatcaaactcacttttaaaatccccctttgaggttattagctgctttgtctaacccaatgtcatatgcttctccactgtgcatgctctccagatatgcatataagtcactgataatcatgaatgagtctgcatttggaattgattcagtgtgaagtatttaaagattcttcacaaggggttcactcagtctggcattaaaagaagctcagtatctaaatcctaggagattgcaaacttgctcagatgctttggaaacctaaacccatgtaaaatacttagatataaagtcattgagaagatgaacttctcatattgtatttgttcggcaagcatttattgacaacccgttgctctgtgcagagcactttagtggaatacgaaagttagtcaaggagtcaaagacccaatcccaagctctaagtggctcctagtttcttggagaaaggagctggaaaggctcagaggattaacatggagcacacttggatctctttcaccctagatggcctcacagaaaggacaccctgcctctgaatagcttccaaccaccttgagacaattttctctcattctaatgccattgccaggatattacagtaatcagatcatttgacgttacctgcatcttagtgtccgcaatcttaatataccatatagatccaagtgtcaggaatctgcagctgcacagtttcacatattatcttgtggtgctaagtctttatgaacaaatagcattgacctctgtgatggtgccgtctaagcacttctttttgtcagcaaatatactatcttatagagaactcacaggttgtaataggaaattattcttccttacataatgtaaaaaacactggttatgcctagggttaatgtagtctgctaatttgtaacagcagagctttgtgaggtattcacagcaggcctccgtgctaaagtcctggtgctgctgttctgattgatcaatgttcttgtgcgatgtttgttaaatattttgcctatcacccccctcctgcttatacctatacgtaaaccatgaaaaagtaatttcttactcattgcaagttccccctcagggcctttggcccttactcttactcttttccctgtctagaacatttctttcttagctattatgctttgctgctccaaatgctacctctttttttctctttctgtatgtatgtgtgtgtgtgtgtatataatatatatcatatattataataatatatatcatatattataataatatatatcatatattataataatatatatcatatattattataatatatatcatatattattataatatatatcatatattatgatatatcatatattataataatatatatcatatattatgatagatcatatattatatgatatatattattataatatatgatatatatcatataatatgatatatattattatatattaatataatatattactatataatataattataattattatatattaacaatatacaatataattatgtgataatatataatatattatatgattatattatgtgattattatattattatattatatattatgattattataatatattaatatagaatatataataaatatattctatattatatataatatatataatatattatatattattatatgataaataatatagattgtcatattataatctataatatattatagattattatattataatatataatatagtttatgattattctaatataatatgttgtcatgtacacatggccttgtgtcattagttgtattttcactgctcctgtctcactcccttgactagattataaactctctgaggctaataaaaataatttttttgtatgtgtgtttatgttttatatatacacacatatgtatactgtattctcccgatgtataaatataaaatctattattatctgccatcctttcaccaccaaactaaaatgcaagttcctagaaaacaaattatagtacatagtaggcactcaataaatatgtgtaaataaagatatatatataatatttgtaaatacgcacataaatatgcatgtttatatgtatctgtaatatgtatgtgtaaaaatgtatatatgtatacttatgtatatgtatctgtaaatatgatattggtctgcatgtatgttcacaaatgaagggtgtgtcaggtatagatattttaattcagctgagtatggattaaaggtgatcattctgtgtaataactggcaagcagtcagtgatcatgtcaaaccatgcctgttaactctagcatctcaaccttaactagtaactgggagataatgaattttatacaaattgtaggaatttttgagtaatatgtatttagtaattttggtaccatccttacaatttctacattgtgtaggcttattgtacagtgttcttcctttttcactccatttgttcatgtcttatctcttcctcagatttgttttcaacaaatccatattttgtctcacttattttgaattcaatttagtgcatgaaaatgataatgttattgttattagcagtaaagataaatcctcactatataccaggcactgttctatatgatttgcatggattagctcagtcagttctgaaaacagccctgtactgtaggtcttattaaggttaagtaacttgcagaaggtcacacaccttgtaagtgatgtactcaggaccccaaatcaggaaatctaactttggagtctgtattttgcctcactgcctatttcaaataatatagcaatattatacggcctttaaaaaatcttaagttgagaaatgcttaagacctctgtgaaaatatatagaagaaaatccttaagaatcatttagcaggtagactatgtaataaaatagactccagaactgaaatgaactttatgataatggtgatagtcagaagttgttgaagaaagagaatgattggcaatataaagactgagctgccttaggactgccaaaaacaaattcgggaagtgaataaccaatatgctgtaatcaacagggaagggcagaccataaaacaactaggcacattaatgtaagatattgggaaaaatagttcacattgaataaataaaaatgtgttaataataactattaagatctagaatcacatgtgttagagagaataaatctagcatagatggaatcatacatttcaacttgatttacacactactcaacagccacaaaacagcaaattacccaaacttgcctgattatcagaatcgcctgggttgcttatcaaaattacagaatcctaggctctacctcccagggcagttgttctcaactgagggcaattttgcctcccagaaacatttggcatatctggagacattttggtagtcataactggaggtgtgctactggcatctagtgagtagaggccagggatgctgttaagcattctaaaacacacaggacagcccccaaaacaaaggattatctggcttaatatgtcaacagtgctgcagcccagaaactcatatctagagattttgattcagtggtctgtgatgaggctttgaaatctgcatttctgtctatggatccaagtttttctgataaaagattggaaacttggtgctatcaatagagttggacttgttgaaaaacatcccatggaagggaatgcttaaggtaggctttgagtagggatagaatagaaacaaaagatgtaaagagggaagaacattcaaatagaagagcaaatcacacccagtaggataaaaaaaggctgtgaaccaacactgggccagccagcaataaatagtgagaatcatttgcaaagcaacctcctctttctgcatggaaggccaactgtgcctcatggcatgtaacttgcatctcccaccttagattttagctgacaataaatgcatgctatgtcattctaactcacttcttagtccccaatatgaagataaaatagcccacgcccactcatttttctaataatatcttccataaaatcccaaaatataaagaaagggagtgagaatgatatttcatcagatatatctggtttaatatccaactctgtctttcattagccatgtgagtttggacataataatagggttaaatgggtggtttccattaaataatgcatgtagagaaattaactcaacatcaggaatatagaaaatagtaaagatcagctgctatttactattattattatttattaaagtaatatttatctaagagaactatggcattatttaaatgaacagaaaaagtacaagttgggatttaagatgatggcaggttcttatcatcaatcacagcaactgattattttgtgctttgttttgtttgaaggggattgagaaaatcctgcttcatagaaatgagtattttaaaatggctccaggtttgaaactattcaccctcagttctcaaggtttttaaaaatctgaatacaatacaaaacgattcaatttggctgcttaatttggtcatggtttccactgtgtttctgtatttatgataagaaagttaacacacgtgagtgtgttttctaaaaaaaaaaatgacttcttttggctatgaattaaggtatataaatacataaaatatacactataatatttataataaatccttataccagctattctagtgtccagagttctatgaaacatagtttaaaaacttctggataagattaatatatattcccagcttgaagatgagtgtgttatatggtatggaatgaagaaggtcaccactctagttcagatagattacatcaatggttttctcttgactagagagtcaatactcctgcatggtcagagagtaggtttgtctggcatgattatctcttcacgaaagcatcttgactctttcaagatgtttgcaaattgattgcttgatgatgtgtcccagtatccttccagacaacagatttgggtaaatttctgcgttttcaagacccatttaaacttcctcttttacaaaagatgatcattacatttacttctatagattcactgcctaggagttcatttcagaattaggccctctatagctgtagctgttcatattctttcttccccactaagaatatatcacttgcttgcctggcctgtcagctggtatatgtgaaatgaatgtgagataattttgaatcatagcctaagctaaacattattaagaagacaaattgtccgaggataggaggaggtgaggattacaaagaaaataacaacaacaacaacaaaagaagaatgaaaatccatatattcttatattatcaggatggattagactctttagttaccattctaactcattttagttaagcctctcctatatactaagtatctcaataataatcaaataggtctcacagacctccccttttagatagttcatgaagaagataaatcactaaaacatatgttgagtcagggagatgaatgccaaagggaaaaataagatagggaaaatgtgtagaatgtgtccagagtagttgggaaatgttgcactgagaaggtgacacttgagtaaatgaggggacaaaggggcaatccatgtggccctctggcagaagaaccttctaggaagagaaaacagcaagtgcaaaggcctgaggacaggagaatgcttggcatttttgtggagtagtgaggagatcagactgattgggaaggattcagataggtgaatgaggggttgccagagtcagatgaagttggccaagtgtagggccaccatacattccagttagcctggtgtagtctgggttcatccctgagtagctgattatgtgcactatccgctctccctctcaaaaaaggttctgcttggatgataaattatatggcgatccttggttagtaaggcactcttaagatttagcttttagtcttagagacatgagaagccacggagggtttggtcagaagaggggtttcacatgacttaggttgcatcaggatcacttcgtcttctgtgttgagaataaaatattgagatgggttggcaaatgggaagccagttaggaaccgatatggtttggctctgtgtccccacccaaatctcatcttgtagcttccataattcccatgtgttgtgggagggacctcgggggagatgactgaattatgagagcgggtctttcctgtgctgttgtcgtgatagtgaatgggtcgcacgagatctaatggttttaaaaacgggactttccctgcacaaacttctttttttttctgcctgacaccatccacgtaagatgtgacttgttcccctttccttccacggtgattgtaaggcctcccacccacgtggaactgtgagtctaactaaacatctttctcttgtaaattgcccagtctcaggtatgtctttatcagcagcgtgaaaacagactgatagcagaaacctatgggattttcattcgagactatgcaatgcagccagagagttgagttgtttcacttgaggacatgtagctagctggtggtggaaatggatctaggattaattctcctgacttccagtctggacttcttcccacagtgcccagtttctctttcagtttaaacttgagaacaaatagaatgccttgctcgctcttttcaggcctattaagtctccagtttgatggcacaactcagttccttcctcttcccattgtgagaaataggcatgacccccacaacctccccgaacctttttcccctttctcctgaaatagctcattttgcatatattaaccaggaatttttaggactttctgttgaacttctgtatttatacttctggctcttataacctctacagaatactgaatttcacgtgtacagtacatatttattaactcatgaatgtgtgatagaagcaaatcaataaggatggagtctaagtacagatgtgaatatatgttttatgcctgtttaaataggaatatgtgtattaattggaattaaatggattcccatgggtctaattatgtctgtgaattcttcaattttgtttatattttatttccacttgattcttattttatttttacaggaattagccctggtttttgatcgttgctttcctcagttagagtggctgagaggagcaatgtatgtacagattatacatttttttatagtcaactacaattgaatatcagagaatgcactcaaggcattgagatatatatgtgcattagattctgttttaaatatgtgtgcttgagatataaacttgtgggtgtgatatggacagacatatttacacacgtggtatttcaagtagcctgtatgcccatggggagttactcagacagtgaaattaaaatttatgttatttctaccggcccacaaattccagcaaatttggcatccaacagggcaaaatagattgtcatataatgtgcttatctctcatgggaataaaataagaataagctaactctcagggcatatgtaagaaatgagtggacaaaaagcattttataatgtgttacgaaatgtaaggtggtatttattgtcttgatttttttattgcacacatatgcttgagatttcttttctttttccccaccgtccagtgcccataccttattctcagccctgtatttcatatgacaaacaaaaagtaattgggttattttaaggactcctcctttgagtgaggtaggagctaggaacctctcagtcattacatgtgggagtccgcccacttttggttgggtgtgtgagaaaggggcacagatatactgtcagtgcccacacttgggtataaaagaagcaaaaacaaaacccacagtggattgcagagattttagaggagaaagataacgaagagggaaaaaaaatcaattgtttgaatgtgggtattcaaaatacttaacaacctataagcaaaggctcagagcactttaagtagacacatgcagtgaagtggtgtctgttctgattagaatgggttaaagaaaaaagctaaaaacctcaaatcctattccagtagtcaactctggattgttatttttaaattttattgcaggaaaaaaacttagttttctttaaattttgactttactttcttataaatattgaatcaaactttatgcatcagaaccaaaatctgtacatttctgcaaatattttttgctgatccatgcatgaaacaggtacaaggttttatctatggagattcaagaaagagacacacctctgacccactgtatttcttatttgaactcctgaatctattataaaagttgctttcccatgtagttatttgaagtcctggtggggcctagcggaaccaataatccaaagtagtggataatccaagaatgtcatttatatttggctttggaatacattaccagatgttactctagcagatttcctttcctaattaggcctcacttaaagtaggagttaattttgtcttcattagctgtttccaagtcagcaggatggggcaaggaggaagcctggggcatgctgggtatttggggggagttggcccagtgctaaacgtctgtggtagatcctgttcaaagaacaaaattcaaacacagataatcaagttgatgggaatatacactggaaatgtttatgaacaccttcttgaagaattctcaggcctttgtcaactcttttttttttttttctattaatcatgagtgcaaaaaaattccgtaataggaattaggcaaataatcacattaaattttgtacagaaaaaaaattagaggctcagagaggttaagtcacctctcacacagattgatctctaagtacacagtacctaagatactgaaactgattaatgaatgataagaagaccccactgtttccttcttattgatgatttgaataatgaggaagcgagaattcttctggcctaattcacattaagagagccaagataatgaagctgtgattaaatggctattaaactatttttatcaaacagagatcaagcgagtgtgagaatctggggacacagagtgtaattgcaatcctacaggatccagaaaaaattactaacataagcagggcatggtcctttcataatagctcgcatttagaagtctttgggataccgcatgcagtattcactctgcatttctcccttcaggtggcagttagcatctcagagtccctcctctcctccttaatttagtggatttattgaccctctgtgtgcagttgggtgagttgaatgcactgtctgccacaccatgtataaccagttggaagatccttttgccaactgtgcacaaaggaagaagacccaaatattacaaactgggttcagaattttaatgtagaggtgcccctggctacctgaagggccagaacctatcttctttcaactatgccttttaaatgatgtcagactagtacaggtcatagagggactcagctgtcccaaagagcagagataaaccttctcattttgttgactgttctaaactatcatttattaacgacacggtaacacttaggaattgttgcagattctaaattttgggttgttagtataaatgcatgtgtatcatctgtcactggaaattctttacaccatgagtgagtttttgttgatgtgccttctttcttcctagagcgcccttagagaataaggtgttacagtcacacagacctttatttaggtcggaagaattgcattgtgtaaggagaacccaaggttgacacccaccatgggaaatgctgtttgatagccacagagctcaactgtggaaatgcccgttggcctgttttctacctttccttccgcctctgctgccagctccaaggctgagcttagtttgtgcagctgtagatcactgtctaattggtgacctgctctttcttcctccctactctgcattttcttttcttttttccccaactcggatggagctaagacatatattttttgtaaaatagtattttcaaacaattagaaagcagtatcagagccgagtctttgaaaggttatcttgcaatgtcagtgcagtgactaatgtgtttctataccctgtcacctgtgaacagacatgtgtgagtaggccagtgtgcttcatctgcggtgactttgatttatttgctctgtaaattgggaccaaagcaataatgggaagtgacattaattgtttaacagagtcctctttgtcacatccattgccttctccggggtgtttgattgttgaaactcatgctaaactaattgaaattgccacagtgaggggcaatatccactcaacattatataaacacaaagtgtcatcagcaaatagcaagttttcttcccagttttctatgattaaagaaaacacagacaatttgaaacaataactttttccttccttaattcactaaaaaatttactaaaataaatggtcttggagcacctctgtgagtcacccacatacagagataacaataatatcgaataatcatttgtaatggatacagaccgtaaataatcattacagccctatggtagatactggttgaatagtagcccttactacccacatactccaacacacacacacacacacacacacacacacacacacacacaagccgccatgctaatctcccatcttacaaatcctccctctcattgtgtttccagtagagaggggaattaaaatagttggtggtttaatcagatcttataaattaattatgacattatcaagctccaatatttttgccattgtatttgttatacattctcccagacttattaaagaaattggagaaaactggttgatttaagtgttctttgtcgttttaacttgattggaattatcatagtttgtttacactagggatagagctaaggcgccattgtattatgtgattgaaagcaaataacggcttgtagtattgctggaaagccaaacacaaaatttacatcatagtaaacaaaattatccatttattggtaaatattcttaactctttttcttgaactgtttttgaacatcaatgaaataagcctttttgaaaaacggaatacttggaaaaatgcccaatttactgaaagtgtgtatatgtgtctgtgtgtgcatgtgtatttgatgtattttctaaaattattagataatatggagatagttataatggtgtaaatctcatgactttgagatgattttttaaatacatgtatttcatttaaatataattgtattcagaacagttaaataacctcaatttaatttttgtatgtgggggaatcaaagaagggagttattgaaatctttggataccagattatgatcctgggcagaaaataaggaatatcatttcagcctatttaatattagaattacatatacagggtcctttcaaaggcatattgaaagaaggtagattgaagaatctacctgagggcctgagggtattcaataagcttcagttattgacttgtgcaatttggatttttacaattggtcagtttatggaagtaggtggcaccattttgaagttaacagttaccccttctgattaggatttgcctcctaaactagaggtttggttgttttttttttttgagacagagtctccctctgtcacccatactggagtgcagtggcgtgatcttggctcactgcaacctcagcctcctgggttcaagcaattttcttgcctcagcctcctgagtagctgagattacaggtatgtgctaccacacccagctaatttatatatatgtgtgtgtgtatatatatatgttttttttgagacagagtctcgctgtgtcgcccaggctggagtgcagtggcaagatcttgactcactgcaagctccaccccccgggttcacaccattctcctgcctcagcctcccgtgtagctgggactacaggcgtccgccaccacgcctggctaatttttttgtatttttagtagagacagggtttcaccatgttagccaggatggtcttgatctcctgaccaagtgatccgcctgcctcaacctaccaaagtgctgggattataggcgtgaaccaccgtgcccagccaatttttatatttttaatagagacgaggtttcaccacattggccaggctggccttgaactcttggcctcaagtgatcttcctgccttggcctcccaaagtgctaggattacaggcatgagccaccgtgccctgcaagtgcattaaagttttaaacttcagacacaccatgttgcacccaaactcaaatccagggacgtgagagggatgcattatgcaaattaaaaaacgtcaattaaagtccctggggagtacaaatggctctttttggcctcttgaatccaaaagaagtccttagttttactgctggatggagggtgatcaggaattaaggaaaacaatttttatgtgaaaatagaatgtatacgtgataaaggcctgcctaatttctctagtaatacaatttgattttctgattagctatcttattctgtgattcttgtaattttgtcaggtcaattaactggagttcagtgctagagagaaaggaagtgtgggtactgctagcttcattagatgtcagcagctaggtgcattttataataaaatctgtgtgggataatttagcccatattgttaatgtcatagcatacagaactttcaaaagaagattttggaagcaggtcagattgaacaaacaatgtgaagtgctaaaagaaggaaaagaaaatggtccagaagatattgttggcaataaatgcagatcaatgaattatttagcaagtaatcattgattagctatgccatgtgcccagtgttggtactggttgtccacgtgcatagaatatcacacactgccttgttaacaaggtacatgtttggaagtccttgaacattttttacagagtactgaaataaatattatattttataatgaattgtttacaggttcttcccttccacagtagtgttattagagggacagattttgtcttgtttctttttgtatctcccacacttcagatgtccctggcacagagtagatgttcaaaaatgtttgttaagtgaatgattgaagattagctttctatgagtgtgttggtgggaatgaatcaaaaacaaggtagaatatatttgcaggagccactattagaaataatagtgcactggggccgggcgcagtagctcacgccggtaatcccagcactttgggaggccgaggtgggtggatcacgaggtcaggagatcgagaccatcctggctaacatggtgaaaccccatcttcactaaaaatacaaaaaaattagccgggcgtggtggcggacacctgtagtcccagctactcgggaggctgaggcaggagaatggcttgaacccaggaggcggagcttgcagtgagccgagatcgcgccactgcactccagtctgggcgatagagcaagaccctgtctcaaaaaaaaaaaaaaagaaaaagaaaaagaaaaagaaataatagtgcactggaatagtaccccagccacaagaaataagtgcatttaacaaacattacaaagtaagactttattcagtgactgatcacagaaagaagagtaaaaatacgtccagagtttgggtatgaagaattgttacccaaactaaagaagtcaaaagaaatagcagttttgttgtgaaaggtatagagtttgggttttggggatgagggagctattatgaagtagaagtgtccagtaggcagttcgagatttatgactaaagttgggagagatgtcagggagcaaaataaataaatgattttggagtgttcagtgatgagattataattgaaaccatgaaagtgtatagttgctttcagtatagttccactttctggtgttgttcaaataaagagctgtctagacagtttggggggtatgctgtataggagattcaaacactatatctgaaaatgaaattgatggttaaaattctctcaaggtccaagattctctaaatcttttcttttactcagggaaagaaagaaaacatgagcaagtggaaaacacttctgtaaccaagaagaattgcatacagcagttttagcactgacataacaaatcgataaattaggcagctcaaccatcagagattagtagagtagaggtattcattaattgtgtcatttggaccaaaacatgaatttggagtttgagaaagacatgatctttgtgttctggaatgggcattctagatttcacgtatggttcactcatttggtcaaacatgttgatgcatagtgttacctgcctcccagggtcaactcacatcttctgtttttttctctttctgcagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctagtaagaacccttcctactgtttagcaggaattggagttgcctctggctacccgctgcatgggtatgatgtagtcacaataaggtttggattttttcatttagaatgatgccaaagcaatccccaagcacactcagagttgcaaattgtgtgattctctgtttaaaagtgttgataatacacgtcttcgtgtagtcttattgcagttttttttactatcttttgctgttatgtgtgtgtatttttctatcttagtgttatttatgttcatgatgaaaacttagaaaatgttggcaactaaaaggaaaagactaaaaatttcacctgtgatttcaaataacctctcatataaaaatgattgcaatatcctttcaagatatatcatgagcatatgggttcaaatttaaatacatgcataatttttaatggttgcatagtattttattgtatggaaatattctaatttattttgcaatcttttatgggtggatatttagttttttcttctatttttcactatttcaaattgtataataattaacatattagcatttttattcttatacatacaatcctagaaagaattggtagatcaacgaatgtgcaatgttttaagactttggatccatatttcttatgaagattgaaaaactatagcacgtttgccacccaagttacttaaatttatggtagacaatgaagactgaatttgttggaaatgaagagagaattttctgttcaatgcagtgcttgaccagagttttattagttctaagacacagtttaccttctcatctatgatagccatttgtcatttgctaaaaatcagacataaggacatgctgtgtaaattatgggatgccatgatcctccagactctaatatcgtgtttggcatgccatttagaggttgttactctcctatcactaagtttttgaatgttaaaaatactctatgcaaatatatggaggccctactttgagtccattggattttgaggtttctcatatggagaatatctcataagtaattgttatttattctccaatttctccatttgttagtgtcattggctttgctccctagtaccctgatttctttccattgatatcagattgttttcatctattcaatttgttcatttgggaagagcagttgactcagagacatactgtatgtcagaacagggaagtccttgagggtcatccagtgaaatgaagaaacagaggtcaggagacagcaaatactttgcctgtgtcagaacccacatctcctgatccacaggccaggactctacttacaaatcctttttttcttttctaaaatcagtgatagtcattcttttatccaaacattctttgaatcagtaatttcatacaccaggttatgaaacacggttcaaagcatcacaaaatctttcatttgttgccacttgacttatttggatttttagaaagaaaatgtgtatctattctcccccaccccccacactccactcccatgtcttcatttagcaaggcagcttttctcacctagtagtgatttggaaattattttagaaagatgttttttgctttatttgttcaaaaaaaatatgtagacaacaccaagtccaatttatgcagtaatcccttatggctggaaattttgagattttccttctacttttcactattatttcttgtataataattggcacatttgcatttttgttcttatgcatacgattctagaaattgaattggaaggaaaggaaatattttcatagttggtagtgtaatgccaaacttttttctactctttaaatatcatatttcctgtagcactattgcgctaaggtgtgacataaataaaatgatagaattaacttttataattataataaattacatttaaaatttcaataacttattccaatgcttaaaagatgcataactttacttgcttttccctttccctgataatgtttctagcttaagaagctcttactggcaccagccaacactcagctaagttataatgaatgcagtggtctcagtacccagaaccatgcaaatcacaatcacaggatcagaacaaaccctgcaattgttaaggtacaaatgtaaattttttaatacaggggggatgtaccaaaggattttggcttgaagcagtaaaacaaataagtttgtaggtattaattcagctgggaccccgaagctgcctcataatgatgaaatagattatgaatgggattccgtaaacagcgcttgagctactttaaactaggcagagttcatttacgcatcgtctttgggtgtttggaatggaagtgccactgtctgttagttcttgcccactttattgttacctgcagcattgtgggccacggtaaaatttgctgataagctggtattatctatgagtggctttaagatgcagaattgctgttttgctagctgtctaacctgagaaagattgcttttggaatcaccacaaaacatctatctctgccattaattggatggaatgctggcaatgccataattcagctagtgggctgtattaaacaatgtttgtcttgctattcactgtgagtgaaaacggagcattaaggggtacttaagagagttgtgagtactgggcgtcagcaatcagtggcaaattaaggtttaagccagccgattttttttattcacaataaaggcgctgtagggtcttgttagttacatgttgctgagtaggaacattgaaatgtaggagaaataaaataaaaagctgcataaatgtcatttaggaattttaaatgtaattttctttccttgttctgcaaacagttattcacagctcatagatctagtacacttagactgaacacttcattgaaaaatcccatctctccagaaaacctatatccattctgataaggttcagttcactaattttagctttctttatgccttgtttttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaaggtaggctggggaccaaaacgagctgttggtgagggcactggaagcaaagaaagcacatgcaaagtctgagaacacaccaacttcttgcttccgtcccatcagcgtcactctgtggaaagagaattcagcacttattacagagcgggggaagaaacctttccttggacacaggttaaacatattctattcagctgataggcagtctaattcacaagcaccaaaagactcctgaaatgttagccaggtggtgaggaattgcaacatcacatgatgtttatatgaatctcagaatagctgagataattgaggttatgaacaagctgggctaaccaattcattatagagcttttattttttcccttccagtaatggaaaaaatgaggcaccagtgatttgttatatacaccttaagaagtagtaaatagtgtttatgcagcctctcttgattactaagtacattccttttctaattcttcttgttctttcttcttctttctccctctccttctttctccttctcctccttcacctcctgctttctccccttcctcttcttcttcctcttccactccttcttccccttctcctccttttctacaaccacatgctatgctcacagattttattctgtaaataaagatttgaaaaatcctgattgttttctttctatttaagaaagtgcctagattaaactaaacatctgggttgatttttattatcaccatatattgctggagaaggctgatggttctgaggcagatcctggtgatttggggaaaacctctcttggcagagatacaattttctatcttttaggctcctccttctcaaaatgtcgtggtcttagaagcccaaagaccccttgaaatgggcagttgatttaaaacatgccagcttctactttaaccttgtggtggaagtaggcatattataacacaccaattataaacatatacctctttttttttttcactttcattttcccaacttttccttttaactgcagagtgggagccagtgatttctgctttgaaccatgattaattcgtgtaggtatgctgttattgctgctgattcaatacgctttttttccccagtgttctgaattttcttccctcttcactacctcagtattagcccaggattttcagaagccttcctgtaatattttaaaatggctttccattaggttttccctggtagatatctcaaatccactgcccatcactttctgtcagtttgggaaaatataattagtgaaatggaccgcattctcattgctccagctggatcttcctcataagcactagaacagtttttcctggagtagaaccactctgccataggccttgttggtcatgaaggcctcaggtgaggggaagcagatgagctcgctctagtgagtgaacaaatgaattcaccgggctactcctcaccctgtgctggtcatgcatgcattttctggggccaaatttaaagtccttgtaatatgtgacccagcccggcagcacaggttttaaagttgttttttttttcttttagtaaacttttacaaatcatgacaatgaagaattaaataggcctttggaggaaattttctttagatgagactggctgtatttggtatatatctgtggcaaggtacaaaacgctcaccccagaacaaaacctgttgacaaacagacaaaattctttagttatgaaaggcttaaaagaaatgaaacatggctgacaagtaagaactaataaatgctcaacttcagtgattatttgaattattattcaaaatcaaaatgcggaaaatacatgaacaattagagataactaggaggatcgattgaaattacctttcttaaggtgttgtaatttttttctcactgaacatcacgtatgatctccataaaacgttttggagtcaggttcttttccttaggatgattgtctagccatggttgtgtgttgatgtctcatttatttgttcatttattcatgcattcacccaaataccacaatctacatgaaaaagacacattcctgactttaaggatcctactagtctctggtctaccagtcactggaacagggtggattaaactctcaataaaccaaatcaatactcctctaatggtggaattagagagtctgggtttattcagggatcggattctgtatgtggtttggggactgtccccttcttatggctctcatttcctgtttgcctttggtctcattaactatgactgttgccatctcctctcctttcattgactttgaccttacctgtacccaacaatcagaattcgagagtcttcctttgagcatttcaaatagcctaccctacctcttgaaaaccagaatttcagtgactgattttcaatgtacatttattgtgtcacatagcatatagctaatatctggttatattttctatggaagttgtatgaattatcctaattattagttgagtatcataaaacttggtaaagtttcttcataaatggattctttttgaaaaacttgttatattagacatactcaaaaattaatgtaaaatcagctcatttatctgtgtaaatgaaaaactgaatcaatgtatctaatttgttgaagatatgagcttcatatttctggatgtatgatataccattcaactgtgtagatctaaatctataaatatgcaaatactatttatccaagtaaagtgtctaatttcaggttaatttggacatgaataatattttcacatttcaaaaaaattgattgctggggttgattaatttactttaaagtcgttgaatgcaatttcttttgacaataggataaaggaaacagaatcttggccaactctgtgagtaactattttatggccctgaaaatatcacttagtatcattgggtctcagtttcttcaaccataagataagaaactttattctaaagacctttttggttttgacactatgattttcattacataaataactaccacttgaccttttgaaagtaattattttaatgagaaaaaattgacataaacctacatacacataaacatatgcttatagataagcatagatatacataatacatgaatgtatagcccaagtatgcctctcatcatattttcccctccttctgttcaaaatacaagattgccacagagaagcaattgaaattttgggtgagaagattcttaatccacccttcattattgggaaatgcctcctgtaggaggtaagattcagaaaagcacaaaaggcagtagttagcctctttgcaagtctacacacctttcaactgattaacatggtgttttactttagttgtctatcagatttggggatctgaaccccttctaaaccatctggatcaatgcccacaatttgccatcatctctcaattaattttcagtgagtggaatagttactgcatgagctttggcctcatagaaataactattatcagggctagatataaaattatacgttttaggagtaaaatcaactgaatattcataatgttctgtcgccttatagttgctctgctgttttcttgtctaaacaaaccgtgtactgtattccaaattaaaatagaaaacattatttctctctgatggtatgatgcaaattttgtatctgtaacagggagggttcatttttggaaaaattctattttcatatgtgttttcgaatggtagtttactgatgcaaacgctgtttggaatttgttttagcataatggacttttgtctgactttgattcaatattcagagaattccttagtttagtctttgagttttctggttgtttttccaacttgactgttgtggagagaaaagaaatctaaaagacactcaatattacataattagtttcttttttttttctttagccaaaccaacaactttatctcttcctctgaccccagagtcaccaaagtaagtattaagaaatgtaaccattttctgaaagggaagggggttctaatacatttggctacagcaactccatttcagtttgtttttataaatgtgccatatcttccagtgaccccaagggttccccatttgagaacaagactattgaacgcaccttaagtgtggaactctctggaactgcaggtaagccttatatttcacttagaacttgtgtgtgtctgtctgtatatgtgtgtgtgtgtaataagataacagagtgtactgtctatgtggttaatgaaattaacaaagaatacaaaattggataagaagttatctgcaaatatttccagttgtttatttaaaaaaaaaaaactaataaaaaatattgaagcgcttaaaaaacttagactaactgaagagctcttaggcaaacttctgagttggttgcaaatggtgcccttgcactaagtgctttaagtttaggtacttgaaccccaccaaaaagtgagtcgtgggatgtctaaacaagaaattccttggctctggccattgctgataaggttaaaggaacagtacattaaacaagatgctttgaaccagaactatggtgcctacctgcaccgtggtcattgttgctagtttaatttcacactttgtgtttgctaaattaccttcttatgaaaggtctaatgcatgattgcatgacttggtcaagcagtagagtagttaatttcatggtgtagatatatagtgtatgtgtgtgcagactcacacatatgtacatatatacatatttttataggcatgcacacatagacacaaatctttacttataagcatatacttaacatcatttcttaaatacataacactatttcttaaatacattataacttacatatatgtttaggagtagcttttgtgtgtatatatgatatgcagtagaggccttcttatctgaccagtgaggaccagcaattggtgggtttattaaaaaagttgattcaagcttatactgttttattttacctttgcttaaaacacaaaaatatacattcaaatattacagttttggtagaagatggagatctttaccttaagcttattttttactatttgggggtctattgattcatctttcttgtataaaccacactaatatattattatataatacatattatagatggtagccactttttattgcttgctccttgaaggaaaagattagagacattggtatggtagtctgaattcttctagatttttataatttttcaaatattttccaattccacccatccacaactaatttgataacacttcttttagcaatgaccttttttgagtttttttttacaggaatatttttccacactcacatttcattcatttacaggagattttaccatcttacataatttcaatcaccagtacaatgcacatgaactgtttagtctattggggtactgagacacattgataagtagcatgaaagcaaatattatttactggatatgttccaccaccttctaacaaaggtaggcccagaaagcagtttttagtttgttgagtgtgattgtaatagctgtacagatataaattggggaagctgaagtaaagcccaattgcatttatgtaacagaagtgatttagagctttggaaagcaaggagatgaggacttgaaagatgctgaatgaggctagaaggtaaagtttggaaccttcctggagaataacataaagaggagattgagggagatttgttttttctctagagatattctgggcttgaaatgcagtgcaacatataatgtctacaattgtcatctcctcttaaaatcttcagcaaaattggtcgcttagtagtgtttgaagattgtgacaaacactaattgtacctagaaagaatcacaaagggagaaaaagagttatcaaagggaaaacactgcagcatagttcaagtttaaagacattgattggccaaaagagttttttaaaatgataaaggcagttaaaggactgacagaaatatttaggcaatactatcatcctagtgaatgacagaggtgattcatggaaaggaatgtggaggaaattaagctctccataggctaacctgacttggagagccttcagggaaaacaaacaaacaaaaaaaatgcacagattttgaagcgtaggggtggaatggagagaagatgttgatggagcagaagcaagaaagcaggaaaccaaagggatgctcagatgacaatgaatttggcaaggactgtgaaatcaataaggagcaacaagatggcacacacactttccctcctggatcttttgattgctaagactcttttctacatccttgatctcttgtacacctcagtttcctccatttcaaagtcatattcataactactgataaaattgtctactcaaaagactaaaatataggttgaaaaataaaattgccagtatgcaatcatttttgacacacaaaaatggaattttatgtggttcgatctgaagtaaaacagtttataagcagcaaagcttcaattaaaagtagtatatcgtgattttaaagagcagatggcatagcttggtgaagtttacaaaaccttggcttggatgttgggcaaacccaagtttaaattctgaatgacctcccatctagtgtgtggccttggtccatttacttaacctctgaaagactaggattcttatgcatgatatgaagatggttacaatacctacatctcactgggtcagtgtgaggattaaatgagataaaatatgagtgcccccttattatataagtactcaataaatattagatatttaattactaattctgagttaacttcatttgcagtggtcgttgtaccttacttcttatctttccaacttttgactggtttcacctcttcccttttattgcccttgctgtgtatcctctttggcaatctcatatatgaagttatttattctttttctgtgcctcccccaccccctactattttcacatcaaattgaacaaatactgcttttggtgtaggtatggaatttaccaaatcaaggcagaacactcactgatttgagattctctcagcaacagctacttctatgactacaatttctggcaatcaggcactccctaaataggtacttcacatacagtatcttccttactttctgcccatttcattgttgaggaaagatttatacgttgacacaagctatctaatggaccctgggttcaaagcaggtctgcctgaagagaacttatatctctttcctgaagtctgaattttaaagatagtaattgacatatgttatgttaaataggcttcattgcacttgccaagtgtcattgattggtactgtctgccaggagcatcgtgttgagaaagattctaaggccaagtctgtgctcatggggaatgtcatgatcaattagtgatgtctaccataggtgcagcaggtgggtggcaagggtagaaatagcatttatattggtggtttgttgatccttggtctacaggcttaatcagtttgactgcagcagcagaagtgacccaagctttggctcaggccttctggtgtcttctttttctttactctcacaaattttggtgaaattttccaaatgtttaagtggaaatgtaaggagtcaacaaaattctaagacctccagaataatgcctctgccccatctgcagtgtctttgagaaacaggagggatgagataggaagtttgctttattaggtattgccagctggtctgacttctttgtgattgtcctaaactagctcattttggctgataaaaaaactcttctcttttacaggtgtaaaaactaatttgatttcaaaatagctgttagtaaagcaagatgagagaaaagagaatgctcttttggcagaaggcatttaaatctattgcatatggagattttcagagtgctacacttttttgtttctgaaatgggaatggcaaagcaatgtcagctcaacaaggtgacggtttaaaccacagacacgaaggaatttgggtagggaccaaagtgaccccaaaattttatgtatatgtatatatagtttttatttgttattactgtaaacattgtaacagcagtagaactattttataactgataaaatgagaagagcaaaaaatataatcagatgtcatcaccctaaaacaagtaggccttcataatttttttctccattgatatatgtttttccacattattttcatcagaggggacatgtgatttgatgttatttattttttacttaattttttctctacgctttaatcagcagtcattcaaagtgtactttagtagactcacaaataaacaacaacaaaatactcattaaccaatttgtaactaccacttttatgttgaattttacattgcctttgtggactctcaatttaaaagttcactttgctggaaaaatgtactgacaaacagcataaatattgacaaacggctgtagccttttggcatacatactccttgtgtatgtgacatatctttgggaaagtggaccaaagtaaaatatgggtagttgtcggtagttttaaaaggaaaagcatagcatcagagaactggaaggtgattttgacaggccacataatctattcctgtgcttcaagaatctaagaaaggaagacccaacaaattctttttacagcccattccaatgcttggcgactcttactgtcagagatttcttccatatttcaaccatattcttcattttctattttcaatttcattcattttgacccagtgtctataatgacaattcctttattcctaatttttcttctctggaaatggtaccatcctatttcttgtaagccaaggatagcaaaggaattttctctcccacatcagctttggggtttggcaatagccacctgaaatgccaggttccccttacccatcctctatcccagctctgtggggaatttacacaagggtcaattaatgatatcttcatcttccatgagcaagagttggggaattaggcttatgtcataggaatgttctgaagcttttctccaaggccagtttgttacccagtaaccaggggtgataggagaaatacttaaaatgtactggaggcaggccactcccaaatggactgtggccagccagaggaccagcagggtctgttggatagtcttctgtgccaagtgtgaacacttcagttgctgggtcttgtggagctccagtgagtcctggggaagtaggtgcagaaggagagaacactagggcagcttttatctactgaatattttaacaactgctgtagaggtaacggttggtactcagtgaatatcagctttccctctgcactcttgacacccactccaaattcatgaggcctgaaatatgtgagtaggacaagtcacacacctctctttgctcagtcttcctattttggtgtgtttttaagcaacttagaaactcatctcctaattttttttttcttaaatacctgaattggcatgcaacatatgcaaaatcccactgttaaacaaacttgaaagtaagttgcagattttgcagtacattctgcaaaatgttataaactccaaaaaaaaaaaaaaaaaaaaaaaaaaaaagatgccattggtgaatagcacatcacaagaaacagagccagggactcaccatttatcagagtcattcaattaaacaaacaaacccaaaagaaaactcctccaagaaaatcgtttcatagcgataatgaaaaacaaaacaaaacttgtctttgccttttttttttaaataaaagggctgtttaaaaagatgactgtagagtatgtaccacttctcccagatttgctgtgcagaagtgcgtaagtgtgagtgatgtagaggtgcttgtttattatggagcacatttcaatgcagtaatcataaatattgctaaggttgtgctctgttgaaatatgacctacatactcttgattgtttgtgttatgtgatttgtctgacacccattacattctgggtaatagcagccatttgttgctctgcacagcaggctcttttgacaaaagaaaataggcggcaataaaaaagctatagtctgaattacattctgcaccgagctgcactgctgagagtttgtgcaagtgtgttaacaatgctcggaactgcctcttgtcagccttcagcctgtaatggccatctgtcctcacataaatctgtcaaaacctgctaagttcaagagagagcatggaatataccttgtactgtcaacaccaaaatgtacacattccccagaaaatcaacacgcaggaaataatccagaggttatgggaggcattagcactgttgatttgggcttgtggcatgaaatcgagagtccagagattagtgggaagatgagcaaaggtagtggcatcaagggattgagcactgacctccctcttacttcaggggggaaagttgtgggtagcggaggtgaggctagagaaataacaactagttcagaggcagcaaggggttgcctgtctcatcagcagctctgaaaagtttaacactatgttcaaagaaagaaacatacttcttgcacctttgttttgttttgtttggctttgggtctcaactgtatctggagataggctttccattagggaggcacttggtgataggaaatcttgtcatccgtgagatttctcaatcttgctttgagatattctccggttagagatgtttcagtaaacaatgaagggtttagggaattagccaaattatttttctctctccatctactcactaatcttgaaatatcttccattcaataagcaaatattacctatttgtttcaacaaatggtgcccgcagaaatttccagcccttatatttttactcacagggcatatttgatggtctctgggtgtttccatcaattttaagtgtatatgcagaaaaatatacttatgtcaaattttaaagaagcgcttttctattaaaatcgattgtgaagtccctggaggctgagtccctgaaatagcagtatctggtgtcatatccagcacatagtaggtgttcaacgaatgtctgttcaatggccacaggctgtctaatgtgtgacagaggtaaaaggctttgtttttaacccaaagaaagtacaatcaaggtgtcgccactccccagagcaacttgagaaccagttatttaagcgataatgagcttgggtactaggacaagggtttcaaattttcaagactcagaaggatttctatatttgaaatccctagatacctgagctatttttagaaccagtcgctctttaatagtggcctaatttggcgttcctgaagtttaaggtttctttttataaatctaaaatatctgtcaagatatgtatacctgagagtacaaagtggcgtgcggcagacactctagggctggggttctcagatgtggcctgtgaagcatctcattaaaaatgtttacccggtttcccaagtgattcttgggctgctgaaatgtgagacccacgactaaaggagaatctagaaaaaataaaattagtacaaaataataatgcaacaaatgtgcccaagcaacatcctgcaaagcgcttataactgatttggaaagacaagacataattcacattcgaaaagagataagcaaaaatgtatagtaatatgtgattggtatcaatagagggatcctgacagtaaattactaaagaagtaaaaattaccctagcttggggtgatcatgcaaagatttacggagttggatatgaggatgttgaatgccatttcctccaattcaagggctatgtcattggacatatttgattggtatttactcagcaaagagagattattcctcattatttctttaagtatcttaggctcctaggaggaatatttgagaatgtgcttttttttttatctcgctgggaattgcaagtggtaattgaaggtagcatgtagaagaaatcagtatgcatgaataaggcagtgcaattcgtaaataaagcaagtgaaaatggagagaaaagataagattgaccaaataggaatttattaggttgagtaaaagacatacttatctatgagagaggaaacaagagttgagtgtgcctcagtggcacagatgtttcattcagtcatgtaagtcacttcctttgctacagcaaagagaagggcaaagagccatccaagagcagctgttaacaaagggaagcctttttgagactcaggtgtgaccatgagtggagtacagtgtcccattcactttgtgtttgcatttctctgtctttctgagattttctgagttggaactccgaagtcaaaccaccttgcatttgtataccttttcttctctcagggagaattagctttgaataataaaaattgccaaatattggtgtaaaatatttcactttagagaaaacattcattctttccatttcttaattataaagtaggagagtgaggcagcatcttcctgttcatatcaaaatctcatgtggctttctgtgacctacttggctctcgatatatgtgtgttgtgtatgtctgtgtttattttttttccagcaaggtagcatttttttccttgcaacttgccttaagtctaaccccaggcttgttagcagacttgaagttctttttgctgaatggtattcaccccgcctcctaaacagaaaatgtattgtaaactaaaatgctccattgtaagcgtaaactcatttgaactccagcctgcccttcttcaaagttccttggactctggagccacttgacaatggttcttcctcggcacaaacggatgagtagggcttacttgggggaaaactcaacagaggaaactactacgcttcacggactctcccacagtggtttctgatgaaatgttctgccctcctatagaaaagcagaaagagcaacagctgatggctgttcctctttcttcctttttatttatttaattagttagctgctgaagcttggctgagtttcaatccctcagtctcataaccctcccttatgttgtgctctatataaaatggtcggctggcactgtgatatttagtgttactgttcacttaggtttctgttgcagaaccatattttagacagaatgtattagttatgcttacaagaatgtattatacctacattagccatggtttactaggttaatgaactgtggcgacaaagaatcactgccgttaagttgtagagttgctctaggtccctgcattcggctgtcgtatttcactgaacttactttgaagttgcttatgtcactctcaccattgccccatatttcctgtcatcccatcttttttttttttttttcttctaagttgcttaattccttggctccaagggtagattctcttgattggacaaagacccctgagctgcttgcatcctctgcaatgttctttgcagacaaatgctaccaaggctattccgtgattcctcagtctcactttgttaattttccataaagcagcccatacaatccccttgaaaatgcaagctttggtaataatgcctagttccgtgcaggccaggggtgatgcattcatgttttctgggaagcaggatttgttagcattggtgtttgaaatacaaaagatcacagcctcctgctcagcactgtagatccatcttttcttggtgacagaggcttaggggatgagtcagtttttcaggccttgtcatgaaattagtttccttcttcttcactcagtttgaacccttgtctgaaatcttggaaaaattagaaacatgtgtcttcgcatttaagaacattatctctgtctcttttctttctctctctttttttttttttttttaatttttgccttaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaaggtaaaccttggcaaaaccctaataacacaaaaggtgttcctaagaagtaaaaaataaaataaaatacaaataaaaatttgaaatctgcagccattctggcccctgaccactgcaattctggcactgctggaactaacgagaacattgttacactcacatctctctccatgttctcttaaatctgtcacctctgagcacagtgccttgagccagtcctatcagagagagcaatttgttaagaaacttgctcatccaactttttccattacctggagagctgccctgtgccaggatagtggagatccatgcaagataaagctgacagtgtaccagacctggtgctcagtgttaacatcaataagagacgctgagagagagcacatcactcccagccctctaagttgactagatgatcacaaactgtcactgggaaatctccctagtagctgggaagaaaaagccagtctctgtaatacagtgtcccagaggatgctccacagtgccgataaacttgggttaagtggcagttgcaaatgccctttttgcttttctcctctggcgcagatcctgctattactatgagtcaagccactacagacaccgcacgcaccgaaattctcccttgtatgtgagatcacgttcaagatcgccctacagccgtcggcccaggtaatgaggcatgtcattttcctttagctccctttatcccctccttgagatgacaagatgttctccaaaaccctatacccctccccatattattattcattttgctcatgaaaattgaggtggttgacttagtgataaagttatgtttcccaggtatgacagctacgaggaatatcagcacgagaggctgaagagggaagaatatcgcagagagtatgagaagcgagagtctgagagggccaagcaaagggagaggcagaggcagaaggcaattgtaagtggcctggagctcacttttattttaaagtagggtttcttctttttctgtgtgctttttttggtgatagattagaaaataaacaaaagctaagtctttgttagaacaggccattttcagccttttggctttaaaatatccataagtcttcggtccccattgacctaacttattggaaaacaaaatgtttaagtcagtatatttctcactcacagtttcattttgaagttcattactgttttcaccttctgttttgaaaaatggagggagtagagatttttttttcagtcagatatttgttctttctgatcacaggataagtttttctttctgtttcctgttacttctctctttgagcggaaaatgaggagggattgctatctcgtttcagtttttgtctttttggccggcaggagacttaaattgtccatgaagagactgagttcaagttggatttaaaggagcagtggaggaagagttgctaagaaagtcatcatttctggccaggcacgatggctcatgcctgtaatcccagcactttgggaggccaaggcatgtggatcacttaaggccagaagtttgagaccagcctggccaacataggaaacaggaaacgacataggagacaggaaaccctgtctctactaaaaatacaaaaattagccaggcgtggtggtgcatgcctgtaataccagctactagggaggctgaggcaggagaattgcttgaaccagggaggtggaggttgcaatgagctgagatcgcaccacggaactccagcctgggtgacagagtgagactctgtctcaaaaaaaaaaaaaaaaaaaaaaaaaaaaaaaaaaaaaaaaaaaaaagtcatttcttctgcgtgatggtcgtcatctaactgggtaattgacacacccacatttcttatgaactacttttcaatgacattttatggatttcagcaccacttaccagggggtattatattaacttgacatatagacagtgctgacccttctgtgtaaagatccacgttatgttatatttgtttgctgtctgaagatcagtcctcattttcagcagctgctgactagtgggtaggctttaccccaactccctaccgctgtttatcaacctagactttggatggcaaaaataagtcagtccagttgtcaaaatccagcccatgcccatggcagacattcctaatcgataatggaactctttcccattgagccccctcagagccttacggtcttttctgacatgatgctctagggagccatgactaatcaatgagatatagcactgcttttattcagtgcagctgctccctgtgtgctagccactcagagttagctcagtgaagatcagcttttgacatatcttgcatctaagctagccaaggcttagggaaatgatttttgactgtaaaggttagatttatgtgttatctttaaaaaaactcactaacatcaacacaattttgcaaaagctatataaaagagctgactaatggaatcaaaatcaagcattggccaacagttaccagctggaggaaaaaggttaaatgagagatttgttcaacacaggcacttaaggagaaataagtgagaagtaactgaacacttaggtcaaagttttggagggtttgctgccatttaactttgaatctacctaagactgactcaaaggcattttgcaaattacaacaatttgcctcatttttctcaacttccaaatgagcagtgatattaagatttgccaaagtgtcattagttaacacttacgaagactaatgaaaattaaaattcaatttttctaatatcactgtatttaattaatggcctattcaataattataataactcacatttatatagtgccatataatttacaaagccttttaatatggcacattataatcattacaaaagaaaatcatgctgagcgaacatgtaggaaaatgattattttggtgtttgcaaatttatattttataaaatccttcatttttcccccaaaaataggacattaaagagaaagattaatagtttcatcataaatttgcttatatggccatgacacaacacagttgtaactaaagccagattaatattttaatcaaaagcatgtaaataaatgatgtgtttattttatgccttctaaagatgattaagtgccagatattaataaagaaaggaagggaggtgtcttttttgttgctagttcggccctttacagatagagcaagtagtgtcattggtctagatgacacaaaatcaccctgagggtcaccagcctcagcttggaagcagatgctaccctgttgtccctttgtgttacaaatgttgactagttcctctgttaattcttagatgaaagtaatctgtatcagttctcttccaaagagcacttgtaatacaagtgtcaacttgatttttattaaatcattttacattaactagacatttgtgagaattttggctttaaaattcgcttttgtttttgaaaagtagattgaaggaaacctagaacatagagattgtttaccaacagagtggactataagtgataagtgcttaataaagatttgggacttactgtttaaccaatttccacttggacaattacatgctgtttctattgaacatgagtgaaagctcatagctctttctgtaataaatatttgccatttggttgggatataaaattaggaaagacatcgtccctgtatccaaggagcttcaaccatactggcagataaaaatacacaaacaggcaatacagtgtgataagtgctattataaggggtgcatctgtggcactgttggggtggtatattgggggcatccagatctatatatgaaggagaacatcctcagagagggtataagactgatccaaatcctaaagggagaaaggacaaagattttctccacctgcagcatccaatatggtagcctttagccacacggttaatttgattgggccatattaagatgcactgtgtgattggatttagaagacttagtataaaaaaatagtgtaaaatacttcatttatctttttatatcaatcacaaattgatataatagtttggacatgttgagaccaatacaatatattattaacattgaatttttcatatttttactttttaaaatgtggctcttagaaaattttacatgacatactgcattgtatgattactggacattgcttttttagacagcggctatagcttatactaagtctctaaaaaagaataaggtatattgagaaactactagtcgtttaattggaacactgagacacaagaggggcaagaaataagtctagagggaatggtggaagatagcctaaagggtcctataattcatgctaaagattttgaaagctatcttgaaggcatcatggaactatttaatgagtttacctacatgaattttttttattgattcccttcctccaaatagttagctttctagtaccataatgcatccccaaagtatatttttatggacttgagtgcagggatacatgcaatgatttttaactgatttgaaaaaattagcttgaaaattcatacatagaagagctaagggaacaaggacagtccagacttaagttggtcaggtacatgatgttctttcaatgtttgaaacaaccttaaagtaatgagtaagaagcaaattacatttaagatatcttggggtcagtgttgggttgttcattaatcaaagcaatcatatatttagggaaccagaaaaacagagactccaaaaggcaatgaaaaaaaaaaccttcagaaatttaataattgttattttacaaaattaaagtcatctttttaacctttgtctgcattacttctattttgagttccataagtaggaggtgttttaggagatctataaacttttcattgcttatgtttctaaaatcctaattcagcccaagttgagtgagccaaatccaaaaacaaagagaacactaataattagtaattaccaatgcaaaatcttatattgtggttgaatgttaccattgtttcagttggcactttcctgtaatttccatcctgactctttctcaaaaagcaattcactttctgcctttctcagactcgtaagcttgaaataattcaggttatattgggactctgcaaaccagagtttagtacttagtgtctaaactgtcactgctctaatttcttgtggagttctaagtccaactccatttgcaatctgtacagttttctgccagaaaacatgataatgggatgttaatttaaagggcaaatctagacattgtgatatggctcagcactcaaaaccaaaactagatgtgctcaggcggcaatgactgctgcttcacttctctgttggtcagtgtccagctcagaagccagggacagtgtagtactgctgataattataaacttcttccaaatgaaatgaaaaaaattgtgcaattactcagggttttttttttttttttttgagatggagtcttgctctgtctcccaggctggaatgcagtggcgcaatcttggctcactgcaagctccgcctcctgggttcacgccattcttctgcctcagcctcccgagtagctgggactacaggtatccaccaccacgcccggctaattttttgtatttttagtagagacggggtttcaccgtgttggccaggctggtctcaatctcctgacctcgtgatctgcccacctcggcctcccaaagtgctcagagttattcttttttggagaaaatgaaatagctttctatgcaagcctctttaaagagatattttgtgtgggtgagtatatgttatattgtgactctaagttcaatatttagaaatattcagttttatggaaagatgaataattatagagatctgctatacaacatagtacctatagttaattatgctattgtacactttaaaatgttgagaggatagatttcatgttattcacacacacacacatacacacacacacacacacaaaagaaaaaaacacaacacaaggaaattttggaggtgatggatacatatagtaccatgattgtgatgatggtatcaaggatataggcatatgtccaaacccatcaaaatgtatatgtttaatatgtacagttttttgatatatcaattatgcttcagtgaagcttttttaaaaagtagttatgcatactcttattctataattttcatgttttctgacttaccagtatgtttacttgcatgttagcttttatttgcatcttaccttttaaatagactaacctggacttattcacattaaccagacttagacactaagcagggatagtagcacacggtacgtgaatgggggacactttggacaaatttaatgctacaattttgttttttctctaagaacaccccctagtagtaggcatttattgactacctaatgaattaggttagataatcaatattaacggcaagaaagaaaaacacttctcagcattttttagaatcttggtatatctttctatctgtacctttccatgaccctccactccactcacctcttcttttagttggaatacaccatacactcaatttataatatctttgcaatttttgaggcagtcaggttacagctaatctaggaatgaacactagtatttcactgccaaagttgatatgtagtttccttagcatagaaaaaaagatttttacattattctgacttgcaaacgtagagagctgaaatctacattatatcaagctcttccttgttacctaccttaaaggacattttagagagatcacccattaaaagcattaaatgcagtacttggcatagctaagagttcaacaaatgttcatctctctactaccttctgtcttttctttgtcaaaccccttttatcaggagtagtttatttgatgagaaacaaccactgtatgttttcctccagtaactgggaagctctagactctttttgataaagattttagtaatgtgaagtcagttaattcagtcagtttcttgtttctttatttatcccccacgttttggtgtagtgaggatttactatagatgttaatgcaatgtaagtcttcaattttattatccaccccatcagcgtactagcttttatgaaaactgaagctaaaagttatttgataaatgtaccatcctcctcaatagtgaaaactggtccgaaaatcatttttcgaggagctgtttccaaaggtttagagttcctccaagcctttaagaagttgaaaatgtcattaagcattttgatttcttttcctttcatctcctgtttagaaattaatgtcttgaaaaattggctgcaaatgttaagcttttttaaagatatgaaatctattcatctgtctaatacaactgcaacatgtttaaaagaatcagttctttgctagacattttggccaatcttagaaagatttttgtctttgctttctaggcatttggatgccttttattttcatttttagcagtaggaaaatcaagcacttcaataattttctcaaataagcctttcaacatgtattcaatctctgatctttgtaaggtagtgaggcatggccccattcctgtgtttcataaaaagagatggtagaaaaataggtaattcaagtaattgtggaacaccccttcggtttcctgtttctcccctctaggttatatcttctttttactgtagaatgtatcagtatccattataaaaggtcctctggtttatattttgtatgggatcgttgttgcatacaacttcgtataaagctgcaattcagagactgtcccagtatgtctgcatatgggcatacatatggtcgattttcgctttaacttcaaatttccttgaatacataggctgtgtttattcccataatggtagttgagcaatttctttgcaatgtctcaatttctttctctcacttctgcacttccccctcctctctatacagtagtaacttttctaaaaggctcattaaaaaaaaattccttaacacccgtgaaagcaggcgccaggaaatttaagtttagatagcagtcccatcacatttggctgtttgactagagctggctgcataaacagaatggaatgtggtgttatgattcccttgctcaagtgtgtatcgatggtctgggatgtgcctcttcatccatttctactttctgactgccaggatgtgctcggtgctctgaagtggcacaatcacagccttcaattgagacatacaatctacatggaagggcgtcaggcagcctgcactggttactctgcttcatctggtcatttatttagtctcaatgctattgttcgtagagttctgttttaccaactgtttgttatctcctacctttgattttcagaggtgatttttatgagtgagattcctgcaaacatgtagctacttcttacacttaaatctgtaaaaacaaattatggaaatctttgtttcttcactcagctgagctacttgagcaaggtttttttttttttctgtgataaaacaccaaatctaacttcccttctcctttgtattggagagtctcagagaagaaggaccactcttaggcatctttgatgtaatgaagggaatgggataagtgttcaagatgattaattgattagtaactgattgattttatagcagatattcattgatagtctgttatgttttgatgctttgtttaaaatacagtagtgaatagaacagatatggtctctactgtcatgaagcttttattatcctggggaagtggacattaaacagtagataaactattaattacaattggaaaggagagttttccataagagcaactaataggaattctgacctcactgcaagtctcagaaaaaatgtgattgttgagcttaaggttgttgtagacagtgtgtgtatgtgagaggcttgggagtggtgcagtgtgaatagggtgtcccagtagcagggaaagagcatgtgcaaaggctttgggaaggaaggtgcacagtatatactagactaatagaagctcagtgtggctggaaaagagagtcacagaaagaatgcgatataagagataaagcccatgatgacaacaggcccagaccatacagggccttgtaggtcttgttaatgatttaggtctttcattaaaagttatgagaagccattggaatattttagaagttaatggacgtcattggattcctgtttccttagcaaagactatcctaacaacaatggaagaatagattggagaagaataaacatggacacagatccaagttaggagattgtttgttatactagtccagaaagagaagctggaggcttggcttaggacaatggaataaagaaaatagattacagagagatttaggggataaaaattaataggacttgagtggttagacatgtggagaggaacaagagaaaggagtaaagggaggtagttaaatttctgtcctaaataactggctagatggtgttcatttcactaatacaagaacattgggaaagaaccaaatggggagagggcaaggctggagggtcgggcttcggtaatgttggtgtagtgtgaggttcctcaggcacaaccaacctgagatgtcaagtagacagttgattatttgcacctgaggctcagatgaacttactttcctaataaaaaatagaggcgagcatgttacatgtggtagaataagaccagacattggtaagcttatcatccaggaagataaagggtctgcaaattgttcagttacatttcacaaatgcttgtcgggtgcctactccttaccagattcttggccaaatactgggcataagaaaaggaaaaccattcagtaaataagaaagggcatctttttgctttcagtccaaattactcttttcatcacccaagaccagggactctcagtacatccaaagaaaactcttgggcaagctaagtctgtacctcagttctctgcttctagtctttgcttcaacctagcttaaatctctgcaaccttaaattcattttatcattgtttgtccttagtatacatacaaactagttggtgagcacattctttatattaactccttatgttcttaaaactttgagagacatcataacttttggccttatcttcttggaacaagaggtataggattgcttcttacactaagaatgcatttctgtgctgtaaaaaaagaatttatcctcaggctataaatattattcctgtattttgtaggttataaattactgatgactttcagactatgatgatattgactccacttgtgaaaattaggccacacccctctagtctgttcctaaaataagactagatttattggcaaagtgaaatttatagcctcttttatttagctcttattcttcggagactcatggcttaaaatggcctacattttaagactgtatttcttaaattattgtctttggaccacctgcatcaaaatagctgaggtgtgcttgttaaaaatgaaggttgtagaaccttatcttacatttttttttagtacaactagataaagcccaatcatttgcatttttaatcagcaccccaagtaatttttatgtatagtagagtttaagaaccactcttttgaggacgtcagagtttgttcatctcagtattagaattctgagttaatgagaaatgtaatagttttgtaagccaggtcagtttcataacaattttgattcataatcaagtcacaaatgttcaaatatttaataggtattgttccatgatttgaaaaaagaatgcactatacagatttcttttctaacacatcaagttcatctgagagtagaacagagacagataggaaaggtagaaaagagtagaggtgaagagaagaatctatgtgagcaagaagagattgatactgaagaaatgggaattaatacttggttcaaatgtagtctttccttccattgtagtgtatgttttgctctaattgccatgctcagtggggtttcttatgcatgattgtacatttatgaatgtttctagagggttagctttttttttttttttttttttttttgagatggagtctcgctctctcgcccatgctgaagtgcagtggcacaatctcagctcactgcaacctctgcctcccgggttcaagcaattctctgcgtcagcctcctgagtagctgggattgcaggtgcccaccaccacacctggccaatttttgtatttttagtagagatggggtttcaccatcttgcccaggctggtattgaactcctgacctcatgatccacctgcctcggcctcccaaagtgctgggattacaggtgtgagccactgtgcccggccgagggctagcttttttcccactccagaactctctccttccttccccccataggaagagcgccgtgtgatttatgtcggtaaaatcagacctgacacaacacggacagaactgagggaccgttttgaagtttttggtgaaattgaggagtgcacagtaaatctgcgggatgatgggtgagaatcttcaagattatttcttgtttagaagctgacgtatgtaaaaaattatggccataagattactgggatgggagttgccaatgtaagtgctttgacagatgacatgttgagttcagaaccttatttattttctttcatccctgtttattaatctttctagttgagatttcctgtcccagaaataagtatttagctgcttgacaggacaatcacactgataaatggattcagtggctcagacgttggcactggagaagtctcacaaagtagaaagggttacagtcccatatactaatacttcttaaccagctttgaacttttctttgtccgttgcagagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctaggtatggattttattgtacgtggaatgaggaatccataatgtagagctcaagatgggaacaaacataatccgtaggcaccttgggttgaaccatcactttattttactaaagggaatgtttgaatacagatttttaagaaaaacgtataagacagtttcagaagaaaggggcctaggttttggcaagaaaggacagaagtaaattctttgtactatctactcaggtgctgaaaattgtggtaggtatgtatgtggatattgtgtgtttccacatgtgttcatgatttctgtatgtgtgttgtgtgtgcatgcagctttatattttgtgagtgcatgtattgtgtgtatctctgtggatattgtgtgtgtctgtgtgtgttgtgtgaatattaaacatgtatgtgtgtagtattgtgctttgtgtgtgcgtgtgttatgcagatgtgtgtggctatcatgtgtctttgtgtgtgtatgtatgcaggtattgtatgtgtctacatgtgtttatgattcatgtgtgtgtgtgtgtgtgtgtgtttgtaacctgattttgccttccaggcctaccctgaatcctttcacgaaccatagcattgccatcattgttttatggaacagaatatgcaagtctcattttctcttattatttcacagacacttagaaatatcatcattttctatgaactacaactaagagagaagaaaattaaatttcatatactaaatcacactctgctttctttaaaaaaaaaaaaaaaaagaaagaaacacctgttatttgttgagtgcttccatatgccagacactgtgccaggagctttgaaagcattttccatttaattactagaactatcctaggaggtgtatattattactatcatccccattttacagataaggaaactgaagcatacataatattaatttttcctgttataaaagctgtacagactcaaggggtaaaatatggtaaatataaaaaggtattaagaaaaaaattaaaatcatgtatcagcctgtcatccaggaataaccactattaccaacgaagtgatttgccttccagtattttgtctcagcatgtctaatttcttacagttgaatttatatatatatttatttatatatatataaacttccaaattctacttttctcaattaatatataaattcgtgttctgctgtgactcacaagattaaaaataatttattaacatactttaatggttgtacagtattttgctgagtgaatagtaccattatatttagtcattacattatagccaaacatttaatttttaatttttcaatattataaataatgctaaaatggacatcttaatttcctttccaattttaattttgttcctttgcatgtcattccccatctaatgtgtgcatagtaagcctttaaattctttgaggaaggaaagtgataagtgtcttgtgcatatgacataattatattaaatttatttgtaatatttatcatgaaattaacatataaatctagtcctcatcattattagatatctatatgcactttctctgggttggtaaaaagaaggaaacaaatacaaatacagggattttttttcttctgtccaacgaagggatgtcttcctagagtaattgatacaggtgatgtgcattgttcacagggaatatgctataattcactccacaagctaaatagatagtaggaagcagtggagaggcagctgactgttagagagatagcaggctagggatgaaaatatagaatgtggcaagtcatttgttcaaatgttggctgataaaaacagtcaagacggattgaagtcttgagttgatttgacttattttcttcagtgatgaaggccagggtgtttctagtctctcaaaacatctagagtttaaaataagctacctagaggggcctttagatcacgattcatcactggtagagagggaggattggatggtatttccaaattgaactggagcctccttgaaatatttctaagaaggatgcttcctctctcgttatctccctgcctagccggcagcaatagaaactttgccattgctaagctcgctctgtattttctgaaaagtatgtttgatgtgcattgtagtaggatggatttttccaattccctcaagctgtacgatggcacaaaggtagtttttttctgagctccatcattgtatagtctgaagaggccaggctttggaatcccgcagacctgggattgaaatctgacttaccactgccgttgggcaaagaattcaaccccttcagttctgcttcttcatttgtaaaataccatatagtgttattgtgaagattaaataaatgtttgtgatgctattagcacgtgtctggcataacataggtgctcaataaatagtggctatggttataatttaaaatgatgggaatgagaagttagaagtgtaaagtcgttttaaaatggaagaatcgactctaggaatcagctttggaactcaaaacatttttcctgtgtcttgtctttgttccctgaagaattcaaatattcttgtgctcaccatattcagtgttcatgcacatttcagggcataagaatatactggactcaggggttaggagcatacacatatgtcacaatagtaaagcaaaaatgatgtgacacagattagttttaccaagacaggaaagttacttatcattctagatagatttaaccaattttctttctgtttacttgctcccccaaattaagttagcttatacatcctatttctctactactgaaactagataatggtgactacaatattgttagagcaaaacataacgatttcagctactatttatgacccagtattataaatgagagtgagagattaaaatgacttgatcaaggttaaaacagtgaagcccagatttaagttctagttgccatgaatcagtagtctgtgtgtctttctatttactgtcttataagcaaatggatctttctaaagacctcaacgaaaaaaaatcagaggggaaagaccaagagaaattaaagtaggactacaggatccaaacagaaagatgggtcagtattatgaatgtaatagttttgattaggaattagttatgttacataacttaaacatttaaaaaaataaatgacacatacattataaattattcattaactgaaatgaatgtattgtattatcagtattcttgattatacacgtaactttatgtatttctttgccattcattgataaatcgttcccacatcccaatataaatattttcaaccatggttttaataatattttggtgtttgagattagtatattccttcaacaaatattaatttgagtgcctcctttgtgccaacagttttccaggtgctgggaatataagtgtgatgtgatttgtttcaaataatacagtatcattatttctaacaatttattttgaaaaattagagtggcttgagttattactattttcatgcgtgtccatgtgaagagaccaccaaacaggctttgtgtgagcagtaaagctgtttatttcacctgggtgcaggcgggctgagtctgaaaagagagtcagagaagggagatggggtggggccgttgtataagatttgggtaggtaaaggaaaaaggggggttgttctctggtgggcaggagtgggggtcacaaggtacccagttggggagcttttgagccaggatgagccaggagaaggaatttcacaagacaatgtcatcagttaaggcaggaacaggccattttcacttctttcgttgtggaatgtcatcagttaaggcaggaaccggccatctggatgtgtacgtgcaggtcacagaggatatgatggcttagcttgggctcagaggcctgacacctataacatttttattatatcttactgtgctccaatatcctttcattagcgggagagaaattggtggagtagatgttattgcctcagaaattaaatgtaaccacattctatctcatgcaacaaaaaatatttttggttgttttctgagtaacagtgtgcctgtataagtgggtatatatgtgaacactatatttcacagtgaagaaactcttgagaactactatttcacaatttttttaaatatttgctaataaaatacagaaacactgaaattctagagtttgcttagaatattgcaaagtaaggaaatttaaaatattctcaaagagttcctcaaggaaaggtatgtgtgtatgtccctgatggttccaggctgacttttatcacacagactccatcactgggggaatcttccctcttgatctacaatgcaagtggaattctgatttcagactaatctctagcaatgagctagacatttttttttttgtctctacaaaaaagattttgatttgaacagcagttgtttgtgaggccttagcaatacaagaaaaccattcattagcctatgaagagaagcgttgaagccagtgtaatttaagaattgactatttaagatgctattgaggaaagattggccagttttgtctccgttttttatgattgagactgtaattgttctcgttgctcttaccttaaaaaacttgctgaaaaaaactcagtaaagaccaaaggtgatcagaatgaaaggaaaacataaataaagacatttctttgtctttaaatctaggtatgtaaaggtagattgaaactttggaaatgggatggtcaggccggagctagagagcttggtttgcaatcttgtcagcaaaacaacattttaggtcaacgattatgcctctgtagtatctagtattatatccttctattactttgaccatttcgattttgtaatttactctgggaaaaagcatgggaattcttgtattttggtagaattgttagttttccagaatggttttgttttccttcaaataaatgttttcaaaagaattaacgtatttataagaggctttttattatatttccaagcccccctttgttacttgcaagaccagcagaaatatctagctttttcatagaagtcaatggagaaaaaccaggaatatttaacagaattttactttgctttctatattgctaaaacatatctattttgttaaggtctatttgaagtagcagtgaaactgctcaaaagcttacttggactagtttaagagtccaagaagggcatggctttatttatacctgcactttatttcttctttccgaatttactctcctgggatgtgaagcatttctctcaaccttccaatttggggagaatttgcaccaaaaattctgggaggccaagaggtacggaagtagaggaccacatcatatgtcccctcctgcctcaaagagaagcatcaggttgaagtttaggggaaattctcatgattctttctctcatactctactggattttatgctcaattaaattaatcccattgaataggaaaattagttccagcttgtactctcacgtctacatctaagttattgaggaaccatgggcaagtcatttgacgtgtcgggggaaggggagggtggttatctgccagagatatattaacgtgtgctctgcctaactcccagggtgtttaagcctaaacgagtcaacaggtgcgtgtttttgaaagctcactactccccatcctcttcctatatatccatatatatccaataaaatctgactattgttttctaaagtatattgattggaagagttgttatcgaatccagtaatcttgaattggaatgattgagttaatggccatcagcaaagtgtgtatctaaactggcttgtgttttttttcagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattcaaaaggaaatatatatatatatatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatctacttctgcttttcttatttatcgtaaccaaactcctggcatgtttctcagatcagtacccattactcgcttattattattctatttcctctctggctctctttccctttctccttgcttttccatattcatggatgcatttcagctctaaggtaacgtgcatcttctgtatcttgtctttttctaaacggcaaaggcagacgtggtggtttctataacgaacgttcagaggtgaaaaatgacaggggattgtatcaaatggattagctctatttttgtacttaaccctgggaagtgtgtatttttaagtagaagctctttcccctagggaaaaaactcactgaatattcagtatagaaagcgattttgttgtagatggactgaatatttctccaagacttgtaacaggatgcagttccccatcatatggaagtcatcgggttggttaaatatgggatgagctgatagctgaagacacatcgtgctgtcaggatgtccactgtggctggtagatgatgacggtcctaatgacagagaatgcccttgcccaatttcaaatggttgctcccattgccaatcatttgcattgcaagactcaacatatgcaacattggggaaagatggctaaattatattccatcatttccatctcctagagagaaaaagagtgtttgtaaatattggaaatgtgataagagctatcagaagtgcattgaaatctgctaaataacataagatacactccccatggattgttttataccaatataaaattcatcaattatttattttatggaaatggaaaataaaaatctaccattatcttatcttacccaaatactgaatttatctgccactgtggataccaagcactcctgagtttcaatagataagtctcagttcctgacttgtcttctattgttgcttaaattgcataaggcatttttaatcttccggttggaaccagcaaggacattagaactcttccctaaatgcttaactttttaacctaacaagtcttttgagggcggagagaaaatgagggattttcagaagcagcattagtagctgctagtttggtactggaatatcctgattgagataaaggatttatttcatattgtcctcaaaacattgactcactttcattcttgttgatactaatggcaaaataattattaaaaccaaaattgggctgacaaaaataacatttgatatagctttttttaaaaaaagattgtctcaattcaaaagtcctccaaaccaaatctgtctaaactgtatacaatatgatattgaattgaaattcttttttagcattgtcggttttctcttctttgtaggtttatttagctaatcattggatataatttacagccctaataacgttactatactgactcgactgtagtgttactagctacacatttataactcagtattagttatagaatattttaactaaaacattccatttgcaatatttatattaatcttatattttgcaattttcgttgctactccgttttcaaacacactacaatccattataaatcaatctttgtactttatcaaacggcagagagtaataaagaaggtcacaactcatagaggagttccttggaggtttgtaacatcatgatttaaatctcagaaagatttaatcaaaagctgaattaatccctgggggaaaagatagtatatagattctattgatggacacaaagcagcctatttctgttcaccggtctctgttagcatgttggggaaaagaaatacagattttctgtgagagggaaaataagattttcttgtaggggaaggatggtaagacataaccttcacgttatgcttcctcccttccactcaaaatggcccatttttattttccacttactggggcgttatctgttctcctagtgcatggagaatgttaaatgtcctccacccccatgtttcccttgttatattccatgtgattccagtaactatgcagagtcccaaaagctccactctagtcaagcatgtggaatgcggggtcacatgggctggtttccaggtctcttctgtcgtaatcaggtgactgcccttgggcgaattctcagcactggggacactggaaacttgtagaagaaatgattatgaaatgtgaatattttgaggaccaggttcgactgaaaagccataacattgtttcatgactaggatgtaggctaaaggcaagaggccaccactttcccacatgtctcttttctgtccataattaattccagaggaatgtgaccatattctgttcagctcaaaacccattacttaccattaggtgacttataaaggggcagagtgaaattaattaattgaaaagagtaagagaacttttagaggagaaaaccaaatgatcctataatattttcatgattaaattaaatgaatgtaattatacatgcacatatgcacaccaaggcattattataatcaaggaccttaaaatattgtatcatttcaaatttatgcatatagcacttactgaaggcaagtagctagtgtgatacttgaatttgcatattgaccattttcatatattttcatatattaatttatagtaggaagaagctgaattattaggaaaaatcctgggatgatttaaaaaaaatattgtgcttctacttgtttttgaacatcaggggcacttagcaacattatctttttttttccacatagttttctgtgatggattttcaacaagatgacatccaagtgaaagccaaaattaaatgggaaggaaagaatgttaagtggtaaaatcctaaatagcttattagactacttaattggagggaatttattttttgctgctgttaggaactctatagtcaagcttctctttaacaatactaattgatgaaaaaaagtggctatagtattatagttaccacaaaatgccctccagcaagtcatttaaggaaattcacaggtactttcctttgatggacgttggtgttgctgaaaatcaagtcctgtcttcattcgtatcatcattgctttctcacttcatttccaagcaggtcccctgcttattcctctcatagcttcacagtgcgcttgaaagactgacttaattcttaaaagaaaattaggacgtgcttgttcttagtttaaccatctactaggttttcggcttgatcactataccctttaatcagatgtatgactaatgtttcatagtgcttagaagtattgccctctgtaagcacttccctatttgttggcaggaatgtgtatacactatcacagaatgatgattaattactctgcttcctagagaagggtaagttagtaaactggtcacacggcatgtgatggagccgtgttactttcatgtcaggcaatttaatgatcaagtgcaatgcatggcgtcattctcctccacttatctgtttacatgggaaaagcatcctggtactgattcaatgagctgccttttccagggtcaacagtctgaattgcagttccgactatccaacaggaaaacaattgaacagaaagcaaagattggagttcaccatccactgtttggcttcagtatttggagggtgggaagtacctatctgttgggctgactttttgccatttccagtggcaggggtggcggcattaaagggagtgccaatgtgtgcacctgatgaatgaaataattcatagacaactcataagagtttctttgtcacttggtgccagagtctcattgagccactgtgtgccatggcatgccatggcaaaaactaagaccaaaaaggtcacctgaaggaaagagaaggaatcaatagaaggttaaccaaacacatttgaacttcaggcacgaagcaaggtttggacagaggtttcccgtggtttcttatttgccttgtatgccaactcattccatgagattatatagacaaaataggcaattgtgcagctaggctgtagaattgtgaagaaaggaatgaacctcacatattggttctatatgtgagggtagttctgtgtcacatagacagccgctggcctttgattaaaatcctgtgtacttcctggctaccacgttaatgggagacccttgaggatttctccacagctaggtttttggatagaacttttaagctttaattttgtggaatgataaaaagataatccctacattcatagaatacaaagagctctttagatttcaataatgcattgaggaggcccccctattttcttctcattgtttgtttcagttctaccatctcaaagtagccatttccagcaaggaaccttcaccaactttcagcattctgaaggttaaactcaagccccctcaaaagtcgtatctgctatatttcatggagacataacttcatggcattgcaataatttaaagacgttatttgcttgtttttgctgtcttaaaaacttagctttatcagctccttttagaaacttgatcaacttggagactccctttcctagaatcagcgcttagtgacacacctggtcatcctgtatcccagccattggacctcaggtaatgatgttgctcaataagacctcttaacatcctcattttaaaattagagaaatcttcctgtactggtaagaaagcaaatatgaaaagctgccctccatttgaaagtccagtgaattcaggatgtgattaaaacagtgaagataatgacaaagatgatgatggtattagctaacatttattgtggatttatcttttagtcattttacttagctgtttacatgaattttcttcattaatcctcctaaacaaactgtaaggtaggtatacaactcttcccattttattgaggaggaaatggagggttaaggtagctggaaaactgcccagatttgggcaaagtccagttggtcctaaaacttatttttgaaagtctcgtcctatatataatgcctccaggaataaaatattaatcttcaaaagaaatctgttagaggtatttaattgttaaaatttgtgtacttttgttgctaccgtctgactgaaaccaaaatctgcttgtattgcattcatcattctatattgatggaacttctccaacgtactagaaactccacatctagttggcagtatagtaagaaaaaattaaaaaatatattttgtaatagcttcggtaggacactctcaccagaatccttattgtgagtatctatatatctatgtatctgtgtatctatctatcttctatcatctatctatctatcatctatttatccatctgtttatctgtctatccacctacctacatatattgcattttgtggaaagtatattgctgtaagaccaatgtctatgagggttgaggccagagatcctcatacttaatgggcaggaatgacctagtgctgtgattccaaggtgtacgatcttacttacaagggctgataaccaactttacaaagaggtagaaacctcttccataagttaaagtggatttggaggtataaaatggtatattcttaccactgagaagttaaatcacaaaaataatcaaattgaagagctttttatggtttttcaagcactattaaaaagtttctgggctgggcgcagcagctcacacttgtaatcccagcactttgggctgaggcgggcagatcacttgaggtcaggagttcgagaccggcctggccaacatggtgaaaccccaactctactaaaaacatatgaaaattagctaggcgtggtggtgtgcacctgtaatcccagctacttgggaggttgaggcaggagaatcacttgaacctgggaggtggaggttgccgtgagcggagattgtgccactgcactccagcctgggtgacagcgcgagactccatctcaaataaataagtaaataaataagttttcaatttagggctaatataagaaaaaaacttaaaaaataatcagtcccgattttgcagccattggtaaaccagtcattttctcagaaaattcgtctgtcttggagaacacaaaccctaggttattttgactaaagttcatagaattctgaaaatgaaagttcatgaccaacttttcttctttcccacttcataatcttaactgacctcatgctcactgagcatggccactggattggagacgggcctctggtattgcagtgtgagaaactgagcccctctttccagagattcttacagtatcctcagacaagcgataggcacgtggagaatccacctttggacgaaatgcttccttgtttctgtgattacattcattgtcatgacacaatgctagctcggatatcagctgttcatgatagaagaccttcttaagatttcttaaatatgtttatttggatttctctctgcaatgctaacctgtctacaatcaaatcttaggattactgtagatactgatcggtagacactcagtgttctaatttatggatcgccctttgagggtagtgtctttgctgcacctggcatcagttgtagggaaaagcgggctcagtttctaacattgcaatacaagaggcccatctccaatccagtggtcatcctcagtcagcatgaggtcagttaagattatgaagtgggaaagaaggaaaggtggtcataaactttcattttcagaattccatgaaccttaatcaaaatagcctagagttcgtgatcttttttttaattatactttaagttttagggtacatgtgcacaatgtgcaggttagttacatatgtatacatgtgacatgctggtgcgctgcacccactaactcgtcatctagcattaggtatatctcccaatgctacccctcccccctccccccaccccacaacagtccccagagtgtgatgttccccttcctgtgtccatgtgttcccattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacgtatgtgtgcatgtgtctttacagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcccctccagcacctgttgtttcctgactttttaatgatctccattctaactggtgtgagatgatatctcattgtggttttgatttgcatttctctgatggccagtgatggtgagcattttttcatgtgttttttggctgcataaatgtcttcttttgagaaatgtctgttcatgtccttcgcccactttttgatggggttgtttgtttttttcttgtaaatttgtttgagttcattgtagattctggatattagccctttgtcagatgagtaggttgcgaaaattttctccaattttgtgggttgcctgttcactctgatggtagtttcttttgctgtgcagaagctctttagtttacttagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatgatagttgtagatatgcatatgcagcattatttctgagggctctgttctgttccattgatctatatctctgttttggtaccagtaccatgctgttttggttactgtagccttgtagtatagtttgaagtcaggtagcgtgatgcctccagagtttgtgatcttaagacagaagaattttttgagaaatgactggtttgccaatggctgcgaaacagggactgattctttttttaagtgtttctaacttttaattagaaatcatttcaaataaacatgaaagtgcataaaataatagaattgagccccatgtatctcatacccagctttatgagatgttaatattttattcaatatgcttaagattgcacttaaatcacatacctatccctttattctcctttcttcctcagtagcattctctccccaatagttagtatgtgttatgcctactcactttttctctttaactacatttccgtatatccacaaatgagatgcagtattattttgtatcttttgacaatttacatgtttttctactataagtgttcttgtacaatttggcagtagtgcctttcaatgcaaatgcaactagagcaattgagccttggtgtaagccagaaggaaatccttctttccaggggtttggagttgccttaacagctgctcaaagtgtcccagctactcattctttgctgcattcctgacatgcgtcttggtttcctatttatcactttggctcatgcttaagtgcatttatgcaatagctttaaaagtcttcgacccttgatccacacccttctcttgcttattgagtggttgtaaagttgatccaagggaactggaggtcataaaatcacagcagaaaatggaaactcatacctagttattaagagaatgggttcttggatttttcttttttaagtaagaaattttgctacactcctcaccttcccactcccacatacctctgcatggccgggccctgtctagaaaggacactgggaggccccaggactatagaatttatttcttgtaatagtaaccaattaaactagttaccagttggagagcatgttccagcacttaagttaattgaactgttgcaaacgaaatatgattctaaattgtttcagtattccaaatcacttcatgcgtgtagataaaaatgaaaaaaattaccaaattggtttggaatgtgcaaatcaagcatacagtgcgaacatttagatctatgaactgataactgcagtaggtaccttgaaaaactttgtgggcttttttttcttcttcttttgctgagctctcctttgaattcccagaaccactacttgatgtgatagtcaatgaatggaagtcaggtgcaatcagaaggggaactgtctgcatcaggatttttctaccaatttgcccagaaaataatctcttcattattcatttcatgggccaggtaagaagggaattgttgaaaggagatttagcttaatggatgaactgtagtattttattccgggagaatctggctagaatttggtttatgagtccggagggtatagttctccttggggtggtgacccttctgtacctagggccactgcacataaacaatgagtgtctaaattcaagaaggagatggtttcgaggaaaatctcatggcaaatgttgctactttcctgtctccacagtctctcactcttcatgtctcccccatcacccaacatatatgtggatgacagtctgtttccatagctttgtattgctgtgaattttccaaccctctacatagatcaggtcaagggctggaattgaaggggttgtttgagaagtttggatgggctgtgaggctcttggcagcttaatgagtcatcttgagtaacaagtcacacaaaatccatgacaattctcacctctcttcaaggttattccttcccctcccaaaggaaacctaagaaaaagcagtgaaatacatcagttgatttcatgagctctttttgagcggataaaataatttgagttagaatacaggctgccattgttgttgcagttacagttcaagttgcctggcaccatacaacattggaacataaaccactgacaaaaacaaactcatgcagaataaaccgactcgacacaaagagcagagatattaatggaccagtcaggtgcgtgaccaaaaggaaggcttggtcctattacagtttaggcagctgtatccatagtatgagttgaaagattcagagttgatatttttctccaaaatatattctccatggcttacaaataataccggaaacccaacattttttaattcatgtatttttaaattaagaaagacaataaactgtagccatcatcagttctagcaaatcctcacctagatcattttaagaggagagctaaggctgggcttggtggcccacgcctgtaatcccaacactttgggaggctgaggcggatggatcacgaggtcaggagatcgagaccaccctggctaacatggtgaaaccctgtctttactaaaagtacaaaaaataaataaaaaattagccgagcgtggtgacacgtgcctgtagtcccagctactcgggaggctgaggcaggagaatcgcttgaacctcctagggaggcggaggttgcagtgagctgagatcgcaccactgcactcctgcctggacagagacagactccgtctcaaaaaaaaaaaaaaaaaaaaaaaaaaaagctagttgcattaggacagaagtgagagaaataaggttatccaagacctcactgcctggagaaaggcaggaagaagtgacactaggtgctcagagaaaggacaaatagtgagtgtgccatcaatttcactatcatgtggaaatttcagtgggctccttgttcattaaacgtttattgaacattcactttgagccctgtgccaggcatagaaaggataaataatgttcttcctgccttcaagaaacttctaatcaattgtggagacatagatagtattcaacaaactttaaaaagctcacctactgtatcccagacattgttttagtcaccaatgtggtagaaatgaattaataagagaccctgtcctcaagcaatttgcagtctggtggatgtacataaggtaattagtgtataactaataaatgtctcaagatctgtgggaaaaaaaaatttactaaggagggaggaagttcagtgaaggctctaagggatctatatggcctgagctggcccctgacatgtagaattaggcaatgggacgagcagaaatagtacaactctctcttttcctggatctctcctggagttgagagtatccaagtttttgctaatctacccgcttataaacacttacattgttcaattacttagtccaagtgtttgctcaataaaaactttcctgacccatctctcctcactccctgtccccagacttgtagaactcactcctttattgtctctcctgcacattaacctatcacagcactgataatagtatattctaaattatttctttacctttactttgccctttgagtttgtaaggatgctggctgactgctgggatggatgaataaagatggatagaattttcatgtttacctaaacaaatccccaaatgtcctggctctgaatcacttctagaatattcttctcaagctcctataaaatggcaatttatgctttttgagatgggaaaatgatccctgaagccttctctgaagaactgaatgtaaggaatacttgtgtggtggcgtttcccctctcatgtctcattcacagaacactccaaaacataaccattttgctatgacagaaacatgatttcttcatttgcaggcagccatgatgagcttgctcctcctggaccatacaaaacatacgctgtctttccctagcttttggaggtttccccacacaggatagctctggggaggttgttttctgcttgtcttgtttctaagcatcttttgctcatctttcctagccgcacggttctaatttctgattgcctggattatatatcaactaggccaagtttttgattccttagtcacatgggaagttgggtcaggaaggcgggggctgcaaaggactcgggcatagagccagctttcccaggagttggccatgatcgtactgattctgcgtattgttttaagggtacacccctggggggtctagagatttctgctgatcctagggacttagagaagctcaaaacctagcgcaaaagactcatctgagctcaaatggatgaagcctggggatatttgctcatgccttccaaatatctgtctaaaaacgtctcatttctgctatttctatggccaaatgaattgtcacatccatgtgcataccttacccaacaatctgtttatcaagaaagaggagcctgttgtctcccaatttctgctttccaggcgactgatattaattactttgcagcaggaacagtttatctctggctgaaaccaaagcagatgaaaatgctgccgtgctgtaagatttatttatttatttttcttgaaacgatgaatgggatgaagatacttatctgagagaacaggtttcaggtggagcctccgtcagcagtactttgaaatgtattgttagaatatggctgatctgggtaaggaataaaaatagcgtgtcatagtgtgactacattaactcatttccaacacaggaagctgaggcccctgcacaatgatagacttgtcctgaaagtagaaagcacgacccccattaatgacgatggacctagttctcaattactggcattacttaaaagataccgctaatctcagcattttgggaggctgaggtgggtggatcacctgaggtcaggagttcgagaccagcctggccactatagtgaaaccccatttctactaaaaatacaaaaattagccaggtgtggtgacttgcgcctgtagtcccagctactcgggaggctgaggcaggagaatcttttttttttttttttttttttttttttttttttttttttgagatggagtctcgctctgttgcccaggctggaaagtagtggcacaatctcggctcactgcaagctctgcctcccaggttcacgccattctcctgcctcagcctcccgagtagctgggactacaggcacccaccaccaagcctggctaatttttttgtatttttgttttttttttttttagtagagacggggtttcactgtgttagccaggatggtctcgatctcctgacttcgtgatccacccgcctcggcctcccaaaggagaatctcttgaacctgggaggcggaagttgcagtgagctgagatcaggcctctgcactccagcctgggtgacagagcaagactccgtctcaaaacaaacaaacaaacaaaaagatattgctaattgccccaaagctatggccctgctttagacctaatctaagtaccctagtacagagaacaaagttttaaaatcaacctatcccccttcaaattattaagattctacccccaaatgatttcttctgggtagtttgcatgtagattcagcactgaatccccaagaggttgactgagaaataattaggacaacctgacaatgaaataatggtctaccctagttatgggactctagggcatttatttctttacatgtcttagcctcggtttcctcaatagaaaataggaaaagaaagccaacttggtggggttcatctgacccatttttttaggttaatctatctaaaaggacctggcaaacaatggtcatgctccgttttcataattagtggccaagaagataaatgtctttgaaaaaatggaaactagtgataaaatttggggtcaaaggatacatttggttgggtgtggggctcatgcctgtaataccagcactgtgggaggctgaggtgggaatgatgacttgaagccaggagtttaagactagcctgggcaacatagcaagactctaaccctacaaaaaatacaaacatttgctgagtatgatggtacatgcctgcattcctggctagttgggatgctgaagcaggaggatcccttgagctgtggagatcgagttcacagtgaaccatgattatgagacttcactccagccttggcaacatagcaagactctgtctctaaaataataaaacaattaaaaataatgcatttttaaaaaatcaattttattttacttcccatacactgttctagacagtgaggctaagggaaataaaaacaacacaaagactctggccaaggttggaaccagaagctctgggttctagttctggctttaatgttaaccagctgcaattactttgccaatgtgctttatctctccaggatccatcggctacatctgtaaagtaaagagccagacaatttccaattctgacattctatgcaaatgaaaaaatgtactttgtgcatcaacctctcgtcttttcctggccactctagccactcctttatgttctccttcattaactactattcttctacttgaatctttcatgcaaatattcccttagttgttttctttaatcatatttcttttctttgtccatgttttccttgagatgtatcattgactgcagtaacattgacttccctaagaccatgggaaatgactctaaatctatttccccaactgaaatcactctcccaagcttttgactcactaactactggacacctccttttgagttttctcccaaagtttaaacatagtatgtctcaaactgaacccattatcttattcacaaccaaaatctacttatattcttccattttcagagattgtcatcaactcaaatttccctggcccaaagcttaggagtcacacaagccctccctgccattcacaatcacatctaattgattaccaagtcttgtttattttacttctttcaaagccctcaaatcaatcatctttcatctgcatttttccatttacaaccaatttcactatatcttccactttgcagtcaaaacattgcttctaaaatgctaacattctatcctatctatcttatctagagcctaccaacagtttcacctggtttcctggaatcaaacataaagtctctagcatcaagtataagtttatccctgaatgatccccaccctctcattcaaaagttattttcaccacgctctcagccccacagctccactcctactgcaatttttgcgttttgtggaatagactctattatatttctaaaattttgtaaaagctgttctctctgcttggaatgccctacctttctttctctatctgagaggctatgggagttttttccagggtggctaagagcctatgctttggggtaagacatacccgtgatcaaagtccagatctagtatttataagctatgtgatagtaggcaggttgtttatcatctaaattttagtagtattacttttaaaatgcaaataacaatacctgctacataatgtcattgtaaagattaaatatgaggtgtttaatgtgatgccagggacataggaacatcaataattggcaactcatgtttgtcctctacagctagactctatgatcctcctctcttctcctaaccacacctctcatgttctgctctggaatttacattacaggatgccagagacagagtctattttgttcacatttatttagcacttgtcattgtctgacccaagcaggcctaccatagaatttctgtttccatcaagattcaactaagtcactatttcttctaggaagtttttattgaacccctaatcttgcttcagcattggttaattacttaagtaataggctctgtttatacacagttggaattctttctctttcttcagtagagtcttgagtttctggagggcaaagaccgcaccatttacacctttgaatccccaacacttttctcagctccatagagtaacactaaaaaaagcctgtatgaatgcatgagtgaaggaaggaatggctggatgagtgatgaatgagtggattctctctttacctctgtttctttcttttcctcttttccccctcttactatgctccatttaaattctgtttctaagaatcaggtagagaatgtggaaactaatggatatcaggcaggtgaggacacaccttcacccagaggagacatgtagactgccccctggtgctctgctgaaattgtattgatagtggcacctgggaaggaaaggtcctttgatcacaggagctttagacaagctttcccctgagcaagggcatgagaacagcacagacaagctgctggagaattttgcaggccttcctgaaaggagtctgaaaagctggtatgtaggtcagtgtccaccctgggactcagcccacggaggtaaaaataagagcctggaaggactgagtttccagatgcccaggtgagagtggctggggggagatgttctgaaaaggaggaggaaaatctctttaatttgttctctgggacatggcctccaaaccaccttgtaggcaaggcacaaagccgagatgaccctgatatgcatcgaaatgaaaaggtttgtgtgcaaatcagggaagaatcctttctgcacctacaggatggatgccagggagttaacatttggaaatctcagctcagtgccaggacgttgtttgaaaaggagatcttggagcaaatgccagtgaggtacagaggagaagaagtgaggacaaggactccaggaattagctattcaagaatgttccagaaacctgatagctgttttccctgtcaaaaagagagagagagagacaggaaaaaaaaaaaaaaaaggacattcaaacgagcattcatcgaagcaggctgctcagggttttcaagggaattgggagggcagatgctacaaggttattggagtcagtgtcaaatgcgagaacaaagtggcagtgacatgagctaagaaatgactaagcacccgagccctggagtagtaatagatggatccaaatgccaagtgaagcagttgtcttaactcatttgaatacttctgaagaggtgatgaaaaaatagcaggagggatggaacctcttctgttccggaatatcccaagatgataagagaatgttgcataatgttactctgtgatttgcttgatccacccttccctatggctgctttctctttagttttaaaatgaaagttttaggtccagcgcacatagggtttccatttgatataggggctgctgttcctaggatttgattcctacttgcagtgtgggactctccctctccccatgaaggggtgctcagagttttaagaaaagagcatggtttggcattcaagcaggtaagtttttggcttacatagaacttcctctttcttcctctcttgtttttccttttctcatcgctatttatttccatatattgaaaaacctgaataatttggacctaagggatatagtgaagtgagcagagaaaagttaaggaggcaaaattcatatatacaaattgtattgtctcacatggagtgtttgtatatgaagagtaattgagtagatatttagcatatattagatgctttataaatactcctatccctgctgctcccgctccttttcagttccctctttcatttctgctttagtaagataaagattactttgaaaagaattattgtcaatgatagccaccatttactgaatgcctcttctgcagcagactctacattagaatatttgtgacatcagttatgccttatcacaattcagaatgggagcagcaactgtccccactttacagatgaggaaatggagctaacacacagtaagtcacttgctactgctgctaaaaagtgagagagctggaatgcaaatttaggtgttctgcactctaaacccacgttttgctttgtttttgtttttttaatgctgctgcatttctctcatggatcatgcaaatgtagcttcttggagcaaatacatagcattccttcagaactggggccagggctgtttaagttggtgaattacatcttggggtggccatcccttacctttggcattctccttcccactccctctgttcaaacagcaacaaatcatgctgcccttttagtcaagcacccttttattctttcctgaaactgtgtctcaccagccctatccctgtcctttaggggtccagggtcttaattagctaattaaataaacttatcttgcctaatagctcttaattccaaagtcagtgcctttccttaggtactaaatacagagtcaaatagagaaatttcagttggtaaaggttgctgagaaagataaatttttgaagtagacaaaactttattgcctcccaaacctcagagaagcagtcacttattctatccacatgtttttggcatttccttgcttacaaaaccccacagaaaaactgggtattgagatctaagcctctaattgtcttaataagtttcagttagaaatgactttccataatttgttaaatatttcctgagcacctcctatgtgctaagctctgttctaggtaagacattcagagggaagcaactcaagcacctggagatggcctatgctacaggttgagtatcccttctccaaaatgcttgggaccagaagtgctttgaattgtccatttggggggctttaggatatttgtattacacttgctgcttaagtgtccctaatctgaaaacctgaaatccaaaatgctccaatgagcatttcctttgggcatcatgtcagccctcaaaaagttttggattttagagcatttgggatttcagatattcaaattcgggatgctaaacctgtaccaaaaattttccctctatctatcgtcctctgtcattagagaattttatagcttgttgaccacttaggaagatacccttgaaaagaccaagtatgtgactagggagaaaaaaatattaaggaaaaaaaaaagagaaatattagtttgaaactgctcatttaaaattactagtttcaatcaatgacaattttaagatattaaatacattctggagtaacttgtcaaaaaataaaaaggtgccattactgatattctccaaggtttttctaataagatcagggtcagtgatgggaaataagctggaagatgaatagagtgtcagaatgcaattgagttctaagcagttacagcaagttccccagtaaacacagcttgagcaagtttgttcctgatgatggttagggaggcctttggtgaaaatgacccagagaacagctgctttctcaccgcacaaaatactgctggaccttccttacttaacctattggaaagcttccattggcattctcttgtgagttaaggcagaggaggaggtagcctcatgaacctctctgctcctctgattctgcgctcattttgattttgttaagagacttcattatattctttccatggcccaagtggaaccaaatccaagctccatctactagctgtgtttctttgggcaaatttgtaactcctctaagcctcagtttcttcatctgtaaaatggagataatagtaatatggctaacaataacagcaagcattgataaaatgattatttctctgttgaggcactctatgttggagatacctcatctcattggatgctcacagtccccacaaggtaagtgtgattacacctacaaatagctatttttatcaagaatcatggttgcagttcagaaattactagaggtgacgtttaaaaaacatcatggttatcttttttaaagtacaaatgactgtgtgacttctatgataataatcattgccagagaggagttttcattatttaataagtggaatgctttggaagggcttcttcatgtaaatagatattgctaccttcaactcctactgagtcctctcatggtagtaggttataagacatttagtgggctgaaaatatatattacctggtaaacaagtgtgtagagcacttatgtgtgatactgattccttgtcaaactcagagagacagagaaagaaagaaagagagaacagagggaaagagacaaagatggaaacaaagagaaagagacagagatagaaacaaagagagagagaataatttcatatgcctcatttggcacttgaaaatgaagcaggaaaccatggtgtccccacctgggaccccgattctgtgacctgctttctgatatggtctggaaattcttaacccagtggaacccagggacacaggtgtttcatcttcagcagggtcctgtcggggcctctctacccgaggcctcagtcctacacagagtacattctccttgaaggaggaaaggaagactccctccagctgggctgtcacagaactgctatctcttctctccatccctgctggcctccagtcttttctctgtttcactcttgttatgggagctgtgagaaaagaaaaatcaattctctagctaaggtcagccagtaaaatttgctcctaggtcccctaaccacggcctgatgaatccagccacatttctcccaggttacaattcaataaagcctcctaatggcctttatcatgatttccctccacacaggctcacagcagcgcctttcatgctcccttataaacctccttgtagggcaataattttgtcttttagtttttctggatcattttggaggtgaattgggccagggtgccggggtgagggtgagggctgaaaaaacaaaacttttagccgcatctggttattccatttagttttcgcggcaaattattatagcataaaagtagcttcagatggtgctgactgaggatggcttggcagggttactccctgggctttacctggtccctgagtagttatgcagcatcttttaaatcattcgttcatttatgctaggccaagtgtgagaaatattttatgagcacctaccatgtgctagagaatgaagctgtggagaagaaagagtcccggattgttgctcccaatccaagttggagagacagaccagtaagtaagtcagtgaggacattagaataaaagcatcacagagcccttaactgcttttcaagtggcaagagaagcccccgttttcctccataggggcagagagcatcagagaaaatctttctcggcatagctgccatgaactgaatcttgaatgtcaaggaagaagcagaagtagtgggcttgcacatatgctaaaattccatatctgccatgtgttagccatgttaccctggacctattactgatcctcttaaaatgcaggttcctgagccccaaaataggtcagccttgcttgcagagtttttgtgaaagttaacaaaatataggtaagtgctagacttatatccttatatccaacacaaagtagatactcaagagatgaaattctatttttgttattattatgtataataatttttatttattaagagtttatcaagtataaactcaataataattagaacttgagcacgatccattgaagaaatgaaaagctttcagtttcacggatatttgcaatgggtgtagaggggaagggtaggaaatctggagcggagacatgtggatggttatgcaggagccagttcattgagagccttcagtacaaggcttaatgcagtacaaggctgtcataaactggctcctgcattaagaagtagggattcattgaaggttaaccactttttaggaaggggggtgtgtaagtaattagatatccagatgatgatgtggcccttattgccagctatctgatcccagctcataaagccttggttcactgaccacctagacatggaaaataaaaacccaggcaccactttgcctctgaagaattctcagcaatttttcagaaagtaaaacatcctctgtgaaattcttgaagatttctccccctcactctgaaatgccctgaatttcaagcagctataatgttgctgactcatttctagtttcataaggatctgggttgacttgtcatgttataaatctccagtttatggaatcgctcctactgctgtaaggtagacttggaagtgtgtcaaagggattcaaggtgggcaaaacagaagttgagcttcagtctcattattttgcttattttttcagtgaagggagacctttgatgattttttacaggggccattatttaattttcatcttaaggaaaaaatgtcaagcagtcgactttaaagatatatgtctatgtaagactgattgtatttaaaacaaatttcccagagcttcctttaatctattatagaatctttctatatcattcatggcaaaagtatgtcaggcctttgatgggaagcaaattttctctttttaggattttggtgtgactttgtctattgtggacagggacatctagccactttaagaaactgaacactcaagcctatgggttacaaagaaaatgcaaaggtatggaaatgtgcagtaacagaaaaaaaggctggactgaagacaaatatggcttatgttacaattttgttttggtttgtcttttcctaagattcagctatattggcaaagcctacagaataaacaccacaggacttgaatataagtttgcaagcaatcatgtatcagggcaactctttgctatggagagtaaacttgtttatgtctttgcatgagttcctcactccttccagaatacacagatggatggatggatggatggatgatggattgtcaagaacagtagcccttacctgaaaacataactccttcactcagtgttatatatatatatatttagctttcaaaaagatgtaatctcagctgggcacggtggctaacgtctgtaatcccagcactttgggaggctgaggcgggcggatcaactgaggtcaggagtttgagcctagcctaaccaacatggagaaaccctgtctctactaaaaatacaaaattagcctggcgtggtggcacacacctgtaatcccagctactcgggaggctgaggcaggagagtcacttgaaccggggaggcggaggttgccgtgagctgagatcgcgccgttgcactccagcctgggcaacaagagcaaaactccgtctcgaaagaaaaaaaaaaaggaaaaaaagaaagaaagatataatctctgaatgcactaattattgttactaatttctttgaggttattttgtattgttttgttttgcttttctgctacaccttgctttactcccttctctttctgggtttaatcctccttggactaaagccaaggtcagagagagtaatatgcagtgcaacagcctgcctagtaaaacatatctctttattaggaaattgagcttctaccttttaccaagctgtggtttcttataagaagaaacgctgactcataatacaggcaaggtgatgtgtacatgcaaatacacaattttatcttttaggctgatttcattaaacaacagatctgtggtatctgagaagctgtcaaatactcaggcttgattttacataattatacaatatagaatgacattagctctgtattttcttattgttgtatcatctctctccctccctggaaatgtaagctccatggggggcgagagttttgaggtttttgttaactaattataccatcatctagaacggtgcctaacactaatagaaactcattaattatgtgaataaatgagtaacttagtgcaaagtcaccatactctcctttatttgtttccagtttttgcttcatgcaggcttttggtacctcccttggggagggttcacagcatcacctacaatgagagaatttagggttatttttcaagttcatgtcattataacatggggagctgggatttctgtgctcattctttctccgtgacatcagctgattttaagtcaacctttctatattttttacactctctctttttacttctggcttggctttaattagaagcccattttttcttagttttttttttatgtacatacgtttatttccaaaatgttattaaacttaattttatgctttattttgttccccacaaactatattacattttctttgtaccttctcatttgctcttctcctatgtaattctttcctttcaagtcaccaaacagcaatttgtctgagtttcctgataacatctctctttattttggtatcttctgaggtatattttagccctttttaaatatagcctagataaaataagtacatttaatgtacttggcaagaaagtgttaagcattaactcctaataattcactccttattagtctcctttcaggtaagttgccagacagatttcaagtgataagtggaaggtcactcaaacaaagatccattttcctggataggggaggggcagagtttcaaaagtcacatgtagaagcaaattccttctaatgacagctgtagtttctccaaaatgatagataaataaccttttgtgtagggtgagtagagtcatctttttatacataacagtaagaatagttttgaccaagtttcagtgttcagctataaagacaaagggacagagataaaagcaattaattatcaatataaaggacattgatggtttgctggctatggtaatgagtacaagtatcataactatgaggctttgaataaattcaatgagattctgtgtgtcttcttgagtaggtagtcttgaaatggcaaagtcaattaggactgaagggaaataagagggtagaaaacaagactaaaacactcagtaccttgtaccctaacacccgctgcaacaacaaaaagaaagatattatcaattcccggatcagcatggatttgtgtttgaatcatgaaccatacctgtacaatgtgtgtaagtaattgttaaaaaatacagttatgtggccagaggcggtagctcacgcctgtaatcccagcactttgggaagccgagggggttggatcacgaggtcaggagatcaagaccatcctggctaaaatggtgaaacccccctctccactaaaaaaacaaaaaaaaaacccaaaaaattagccgagcgtggtggcaggcacctgtagtcccagctactcaggaggctgaggcaggagaatggcgtgaacccgggaggtggaagttgcagtgagctgagatcgcaccactgcactccagcctgggcgacagagcaagactctgtctcaaaaaaaaaaaaaaaaaaaatacagttatgttttacatcatataccaactccaactgattggtagtggctgcctagaactttttgcattaggaaggattctcgagtattcagtggtatctgtgagaaataatgctataattatcagcaatgtcttgtgggcatcgtacttgcaagtgctagcattaagtgctatgatttttttgtttattcatgtctaattattacttcatagttaatttcattttattctgttttttgctgttgttgttgtttctaaatctggtattataaaatttacttctgggaagattgatgtatcatgatagccatctggcccttgtattgttgtttgcccagttgggactattgcaaaactgcaccctgacagatttcacggcagatagcgtatatcccacatggactgtgaagaaacaagagactttgacctaagaaaagaataagatattcagtgcaaaattcactgttgattttaccagagcagtgatactaaagacttcaactacattacaaagactctgttaaggatgctttcaacagcaaacaacagcaaacccagttcacagtggtttaaagcaatatgaataactgtttatcatatcacagaaatcaggagatagattgattattgctgatgtgttcagtagtgtaatagtgtcaggatttgcaactcttcaactctcttggggtttttctcatggttatcagagggatgccacatcaccaagtttcatgtccacttttatgtaatgaaaaatggggtaaggtaaagaaccagtggcatccccttttgtcagtaaagtaaagtaaaactttcacatatgacctctgacctttatatgttcttatttagaagcatgtcatatggctaacaccggttgcagaagcagctgggaaaatatatatttacctttactgccctctgtggtggatgagacaaggaggaagggtattaccaatagtctctgttacggtgtacctcttagcctagtggctatccatacatatccttcttcctatagatatgttttaacagaggctattcatctttattccatggaaaataaccacacataatagtatttattttaggatctagctttaagtgcagtattgctcactatcagatccagatgtggatgttctggtctagtgactaatagctaaaaaacaagttatctgttccctttatcctgcataaagtgttggtgagccggccaggtgcagtggctcacgcctgtaatcccagcactttgggaggctgagacaggtggatcacctgaggtgaggagtttgagaccagcctggccaacatgaagaaaacccgtctctactaaaaatacaaaaattagctgggcatggtggcacacacctataatcccagctactgtggaggctgaagcagcagaatcgcttgaacctgggaggcagaagttgcagtgagctgagatcgcaccactgcactccagcctgggcgacagaatgagacgagatcccatctcaaaaaaaaaaaaaaaaaaaaaaatttgtgagggaacaggatacctacaatgaaatctccatcttgggaaaaggaacaacgggaattacttacaaattactggcctataacacacacattaaacagcaaagacttagccctggcagtggagtaaattcctttattagacaatctgcccatccctgtcttttctaggaggatccctagaatctgggaggattagggagataaatatgctaattatgcagatggccacacctgaagtaagcttggagaagatgctcttctgaggaacgtacaactttcctagtttatttcttattcacataggttcaagggcttagggggttaacagtcaaagtctgggtttcttgagcaacatcatcccctcaaaaatatagtaattctgggagtcattttgcttctgataatttccacatgggataattaagagccagtacatgtgtaggcatagtctctaattgtgagacgtgctgtatcctagtgcctaagtttagggattagtctaatggacaacaccttgtggagatatgaaaaatataggcttgtattggaagacattattggagaaattctttgttaaggagcagatgttaaatattggaatgtttttacacttcatggtaggtagctgcttacccaaactagcaatctgtaccctaagatctcactactaaaggtttaatgcttgtcaaagtttaggggccttcaaggatccatctccagccttgttgccaacattcatttgattcttcattgcctccaccttaccaggtattaataaatatgaaatatttcatatatcaactctggcttatactcagggcagcagagaagtatgttccttagtatgggggatcctgggacaaaggcaaacattttccgagaaaatgtcacattaggaaaatgctaatcaaagccttaaaaaggacaacatcaagttgtaaatgccacttacttataagaaagttataaaaaataaagagaaggttaaaaaatagattggttaggccgggcgcggtggctcactcctgtaatcttagcactttaggaggccgaggcaggtggatcatgaggtcaggagatcgagaccaccctggctaacacggcgaaaccctgtctctactaaaaaatacaaaaaaagtagctgggcgtggtggcgggtgcctgtaatcccagctactgaggaggctgaggcaggagaatggcatgaaccagggaggcggagcttgcagtgagccgacatagcgccaccgcactccagcctgggcgatagagcaagactccatctcaaaaaaaaaaaaaaaaaaaaaaaaaaaatagattggttagagacaaagtatgaattggtagaaagtggattcaggagataattatgctaatgtggactaatcactgtggcattcctctcctgtgtgtcttggcacagtgctctgaccaggggcaggcccttaagccattgacccatcttctatacaagccagacaaggaaaggtgagaagcagaagcccatttaatcaagtaccaccagtgtaggcgggcaagggaccaacgactagaaggtcagcaaaagcaaggggggagcaaaaaggtgccacgggcctcagaacacaggcagggtccagagttgaagaggttagaaagttggcagaaacaactctagtaataaggcttgaactttgatcctagggcagaaagtgctccattgtactctattactacctgctgaatgccaatgagttagttaggaccacagatgctgggcactgtcagaaagtctcaaagcctttttatcattaaggccaagacagagatatcagcaagaacttttccggattttactagcacactgttttttaatttttaatttttatccatttattgtcatatttttgagaatatgacattatgattattaacaatagctgagattgttggagggagtgcttacaatatgccagacacagtttttagtgcactacatataataagtatctcatttaactttcataataatatgagggttttttttttgttttaatcatcctcacttcatagagaggatacaagtttccatcctcttcctttacattctttgtacaaactgtacagtttattaaccccatattagtcagggttctctagagggacagaactaacaggatagatgcatatagaaaggggagtgtattaaggagtactgactcacatgatcacaaggtgaagtcccacaataggctgtctgcaagcggaggagcaaggaaccagtctgagtcccaaaacctcaaaagtagacaagctgacagtgcagccttcaatctgtggctgaaggcctgataaccccttgttaaccaccagtaagtccaagactccaaaagctgaagaacttggagtctgatgttcgagggcaggaagcatccagcaaaggagaaaagatgaagcctggaaaactccgcaagtcaagtccttccactttcttctgcctgctttattctagccacactggcagctgattagatggtgcccacccagattaagggtgggtctgcctctccaagtccactgaatcaaatgttaatctcctttggcaacaccatctcagacacacccaagtacaatactttgtgtccttcagtctaatcaagttgacgctcaatattagccatcacaaatccaccccttgtcaacttcaacccatacacacttcctgaaataatacataatcttcaaataaaaacaataataaggtcataattatgcctaacattatacagctttcctttgtacaactggaagtgcactaatccttaacctaagtgctattacataaagttaacaacacttaaacgttgatatgaagtcaataaatcttatgtcacatgataaaggcaaaagaaaggaaataaaatgaagacttttcttaatataattgtatacgtgcacgaataagttcttaacaaaataaagaggaaatactcatgacaattacattcctcgtttctgcaactggtcatgtggtcatagctggtattgatgactaccttctactacccattctgtagtcatagctggtattgatgattaccttcttctactacccttcttctacccatttcctttgccttcagcaaacacctcagcaggtcgtggttttttacctggtggagtgacccaaacctttattcccaaagagtctgggccatttgtaatcctgcctggattgggttgttgtaggttttcattgatcttaattacagggcatggtaatactaagagacaccctaggggatctcctgtattctacacatactcttccttacctccattgtggagtagtagactgcttttatcttgataatctgggtcaatcaccccaaccagcactgtaactcccttcttggccattgacttagaggtaggaggagcccaaagtggccagtggcaatcttaacttccagtttaatggaatcattgttgtgtctcctggtggcagcattcctctttctagaactaagacctctaggcctgcagaacctaatgtcgcaggaagaggaagcaaaatttttgctaatgggtcataggggtgatggtgagtggtgccacttccacttccaccccatgattctggacccatgaatccaggttatgggacaaacggtaccatatattggatgctgattcagagaatacacagccttctggagaactttgccccagccctgcaaagtattgtcacctagttgatgttgtaattgtgacttcaatgggccattccacagttccatcaatccagctgcttcaggatgatggggaacatggtaaaactagtgaatttcatgagaatgagcctactgccacactactttagctataacctgagtgccttggtcagaggcaatgctgtgtggaattccatgatggtagataaggcattctttgagtccatggatggtagtcttggcagaagcattgcatgtaggataggcaaacccatattcacagtaagtgtctattccagtgaggataaaccactgtcctttccatgatggaagaggtccaatataatcaacctgcccccaagtagctgtctgatcaccgcaaggaatggtgccatatcgagggctcagtgttggtctctgctgctggcaaattgggcactcagcagtggctgtagccaggtcagccttggtgagtaaaagtccatgttgctgaccacatgcataacctccattcctgctaccatggtcactttgttcatgggcctatttggaatgataggggtggctggggaaagaggctgagtggtgtccacagaacaagtcatcctatccacttgattattaaaatcctcctctactaaggtcacccattggtgaatattcacatgggatacaaatgtcttcccagtttttgaccactcagagaggtcaattcacatacctcttccccaaatttctttgtcaccagttatccaactatgcttcttccaagtccctgaccacccagccaaaccattggctacagctcatgaattagtatataattgcacatctggccatttctccttccatgaaaagtgcacaaccagttacactgctcaaagttctgcccagtgggaagatttccctttgacacagtcctccagaccccagaatggtagatccactgatagcttgcaccgtgtacctggaaaagtcacagacactcaacatcagcccttgaaggcaaccaggatgggggctgtgccacaggggaggagctgcccaaggctgtgggaacccacctcttgcatcagcatgacctggatgtgagacatggagtcaaaggagataattttggtgctttaagatttgattgccctgctggatttgggactttcatggagtgtgtagccccttcattttggtcaaattctcctgtttggaagagttgtatttaccaaatgactgtacccccattgtatctaagaagtaactaacttacttttgattttataggctcataggcagaagtgacttgccttatctcagatgagactttgaactgtggacttttgagttaatgctgaaatgagttaagactttgggggaccattggaaaggcatgattatgttttgaaatgtgaggacatgagatttgggaggggccaggggcagaataatatggtatggctgtgtcctcatccaaatctcatctcaaattttagctcccataatccccaagtgtcatgggagggaccctgtgggaggtcattgaatcatgggaatgcgtttccccgtgctgttctcatggtagtgaataagtctcatgacatctgatggtttttaaagggcagttcccctgaacatgctctcttgcctgctgccatgtaaaacgtgcgtttgctcctccttcatcctccaccatgattgtaaaacatcctcagcaatgtggaactgtgagtccattaaacctcttttctatataaattacccagtctcagccatttctttatagcagtatgaaaatagactaatacactctttttctgactcactgtcatccatccatccatgcatccatccatccattcactgatttaattaactaatttaacacattgatatgcacatttttatgctaggtgctgggaatacaatggtgaacaacactgacaaactttcttctttggaagttcacagttcagcagaaaaaaatcagttaataaatcatcatttgtgatcaagtgtgaggtacaacaataatatgcaagatacaatgtgacttcattgaaagggcacttaatgttgtttatcaagaggcagaacagactttaagaaaaatatctaaagtgaaaaacaaatggtcactaagagctcgctgagcaggggtaaaactatgttcaagaactagaaaggtacacatttcctaactggaacatcaagtgggaaagacaaaaggatgagagattaagggaaaaaaaaaggcagaatgcccagctgcaaagggcattctgaagggcttgggctttaacttaatggcaccaagaagcctttgataagtgttaaatagatgagtgacatgatttattcattttgcattccagaagtatcactctggccacagtgtggaggacagaccggatggggcaaaactgtaggcaaagtcatctgggatcagtcagttacagtcaccagggaagaaatagtaatgacttgaactttggcactggccattaggatagataacggtggatgggatggagagatgtctaggaagtcaagtcaagcagaacttgtcatgggccttccttatggattgtgtactataatgcctatattgctattcatctggagtaaatatcactgaattaagatttcatgccatgtttgtaacatctaaatgagtgactgggggcttacgggaagcctgtgcctgcaaatatacattttcatatttcataatacaggacaagagaacctctcattttaatgaaataagcacaatatttacagcaaaggatgggttgtattagagcaccagggggcttggtttacacttgaattattttcctccagttatggaaccaaacggaagctccactgggaggcactgaaataaggaacgcagcggggagctttaggggagctcttccctacagtagttgtttattttgaaagaaatgtatggtagaaaatatttccagccactcaaattctactttctggttcacgtgactttttttttttttttttttttaaagggaaggaagccttggagccagattctaagaaagcaaaatgacagcaacaactggggacaatctggactcagcctgggtgcccatgctaggcagtgatgtagaaccagagaagcctcattttaaaatctgtttcacagccagaaagtacatgaatagaagctcctttttcaaattatatttcctacctattgaatttaactttcatccacttgaaaagtctcctattttactgccagtcatctcagtcactattcagcagactatcaagagcaggtttttcttgcctgtggaagatacttttattgttgttgtttcatgatctattctgtaacatactcttatttctatctggctcaggcctaattcccaatctctcatcatttctgagcctaagcacctcatgccttgtcttataaagagttacatcacatttaaactggcatacagataaagccagatatagaagctctttcttgccattaagttatggctctcatgccattgctttctcatcatttcccagggaagaatgcagggtgttagaggcccttcagtacataatggctttttttctcgctccatcatcacaaagcactttcttaaaggatggtggagaagatagagttcctgtgataccaccattagcttctgcccggatgattggaataaacttccactatcacttctgccatcctgcaacacactctctaacctgcagctagtggaattttaaaaatataatctccccttttctgtcccctgtttttaagccttgggaactatttgagcccttcataatcttacctctgattaactctccatagattactgtggtttatccagactgattttctataagttccctggataggctgtgccattcctttcatccaggactttcacatataattctggctctctagaatagtcatccctttctattcttcaggtctcagcttaaccctcatttactctggtttttttttttccctaattattcagaagcccatagttctctttattttccttatcacatctcttaacaattctgttttgtagttgcctgttcagtctgtcttccctgatagaacataagcctcttgaaagcaaggactgcatttctcacttttaaatcatcggcatctagcaccatgactgcagtatagtaagagcttggtaaataattgttaactctttagggtaatagaaaagaaaagttctcagcttcacagcaaaaatccctctcattaatcaatggaactacctaatattaattcattaattcatgttcactcaataaatattttgaacagcttataaatatatcatggactatgttgagtattgaggatatggagatgaataaagatatatttattttcctcaagaaactctggggaaatagagacataaatggttataatatgatgtaatatatggcataataaatgtatgcataaattgctatggaacataaaggaagtaatgtttgtttacctgagcatctaaagggatagactaatatattttgttagactgataaccacttacacttcatcaagactcataactgagaagaactcagtttatgagtttttataagaagggggacttataagaagagctcataactgagcctgatgaagtgttaagtggctatcagtctaacaaaaggaaaaaatcaattcctaaaaggaagaaccaacacatgcaaaggatcaaaagctgatgagaacattagcatatccagtaagctgaatgatcaataatgtgccggatgatggtcattcattgaacctgccaggctagcaaggggctaaatcattatgtcttttgatgcaaataaaaaaaaaattgggggctactgattcattttaggtaggagagagatatgctcaggctggtactccagaaagatcactctagcaccagtgtagaagatggattggaggatggtaatattagaggccaacgagacctgttaggaagactttttaattgcattaaaagtatgagaaatatggtagacctgctgtatgtaagtttctgaccatatatctggagagaaagtgaaatgattatgagtggtttaggaggtagaactgcattgcaaaggtttgaaatatgctcttccttcttggattattatttcctcctttctttagccaagccattcatcctttatcatgcaattcaagggttgcccctggtaagttctctctgactcttccaccgcagtctgactaagataccacctccttaagctcttatcgaatatagcatgttgcctctgcaacattaaattttaagcagtttgaaagctaagagaagattccacttagcaaaatgttatcagagtgactggcatagggtatccattcaataactattttttgcattgatgaatgtatgaatgattaaatgactcctcagaaatgggaagtgagattctcaggcttcttactggacgataaggaaaatgataggaataatcacagagatagaaataacggggagaaacaagtttggagaatagtttgggaaaggtgacaatgatgacatctatttggaacaggatggacttgaggggcttatgagaagaactcctaaaagtgaactggtatgaagtccagagttgtgacttataatttatagagagatggtagtttagttatctatctatagatgattaaatcatagttcagtcacccaggagcattaggtaaactgataataaaatggtctcaacaaagaggcctgagtatcaccaacatagtggttggtgaagaggtcaaggagaaccacaacaaatgtgtggacactaatagagtagtttggagagagtgttgctataggagacaagaacagaatacatttcaggaaatagtcaacaatatcaaatatttccaagaggtcaggtattataagggtaaaaaataatcagttcatttgttttgtaattagactatttgttaagttatttattacttataatgattttaatggagccttggggttaccacggagttggtactggattgaaaattagagtcattagagccagtaagagtaacatgttctaaaaaccttggttgtaatagacgagaaataggtggggtaaagaaggaggagaaatgagaagtgagctacacagtggagggagtttttttttaatatggtaaaagataaacatgatcacatcttgagaataaacagtgatttaagagggaaacattaataatacagggggaggagatgtttcctgaaacaaggcttaggataaaatggtatcgagagcccagatgaaagaattagcattgcctgaaagagagtcacatctctgtctgagattagaaggaagaaaggatcggtacaggcctaagtttgaattaaatggggaattcattcacacttgatttattctatttctccagcaagaaggtatcaagattatcttctgaaagtgaaggggacagaggtgataaagagaacttgtaaatggtgactgttgactggcttctctgggaattaaacatggaagtaagcggagtgataaacaaaattattgtgtagctgtgcagaccttactaaaatgaatgaaaatg

SEQ ID NO: 11 - DNA, 130269 bp, Homo sapiens
gggccatttctggacaacagctgctattttcacttgagccgaagttaatttctcggggagttctcgggcgcgcacaggcagctcggtttgccctgcgattgagctgcgggtcgcggccggcgccggcctctccaatggcaaatgtgtgtggctggaggcgagcgcgaggctttcggcaaaggcagtcgagtgtttgcagaccggggcgagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttacgcacacacacgtgcacacaaggctctggctcgcttccctccctcgtttccagctcctgggcgaatcccacatctgtttcaactctccgccgagggcgagcaggagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggaggtaaaagcgctagcgcgcggagggctcgaggagggcaccgcggctgggccccccgcgccccgggccccagccgtccgcggctcccggcccgacgctccccgccccggagcgcgcccgcctcccctgcgtggaggccggcgggcaggcgagcggggggcggtagcgccgtgccaaggggctggctggggcagcgtggccggccgggctggggcgatttaagagcggtccgggcggggtgcggagccggactttggctggggcggcgcgcggggagggggccgggggcggtggcggcggcgttggggggcggggaggaggcaggaggaggagcagcagcgctcgccgggggatgcagcagcggcagcggcggcggcggcggcggcagcggcagcggcggcgcggagtcccctgcgcccagcggcccggccgggctgcggcagaggcggcggcggcgccccgctccgggtgaggttgccggggccgtgcgcgctggtgagtggggcgtggggggcaggtgggtggctgggggacgcggggctcgggcgggggctcgcggcggccggagccttccccggcgtgagcccggccgcgagcgccgcccaggtgagccggggctggtccggaccgcccggctccagccccagcgctgcttgcggaggtgggtccgggcgggcgggagggaggctccggcgccggccgtccgcagagggatgacctgtttgaccccgctggctggcgggcgggcgaggacttcccgccgcgcccctgacccgcggacacggcacaccgagcacaggcggccccgggtaggggagcgcgcctgggccggccatccgcaggggcatggccttgttgacccttagggtttagacccaagggaccggtagatgccagcccacgtggggcttgtccgggcaggactcggggaagcagtgggccggatcttcagagtggttggaaactcgcagacaccgaaaggacaaacaggatcgaaaaggcagacttcctcccaggccagggcagaacgagtttccatcgcctggcggagggatgctcccctccccggctcctcggggtttcaaaagtctagcggtgaattctaggagtgcacttttccaaacattccttatagtagttcgttcattcgttctacaagcatttctggagcaccccctcgtgccgggcaccgcgttctgttccagggaaacgcggctgaacaggatctggctcctgcgcgccagaagctgccggttcactgggagggcagcagggtagagagatgccgtctcggggtggaagatggaaagggaagcctgcaatcctagtttgcacactggcctcggtccgcaactcccccacctgcacgcagtaggcccagcacacagtaggaagagcaagccagacctgcctgtgacgaccctctcctcctcctcctcccccttgaaagctttgattcattccctgcccccctttctggaaagtcttcctgcagcttgttttaatcactttttgagttaaaagtcaatatttaattaaccaagtaattacattcagcttacgtttcaatctgggtatttgctcatctgtgcgtgttgggacacccgccctctcgcccctccatctgtcccctgcctgtttcccaccgggtccacccccacttttggggcagagaaggggaggctgcgctggagcaggttctcagggggagacagggagcaggagagacgggctttctctggaggacacccccggatctgcgcgctctccaaatttcagcttgtagtgaatagtgaaggtgatttcttgacagcctctgcctcccattacagaaccaccagagggttctaattaaattagagccaatcgttaagtataggaacggggtagggaggacagaacgaagggggccccttccctgtaagagatgttctccccagcttcgtctctcccacatcatagagaagagaaaactcatccagacagcctgtcggatgtgtaatttagcgttctaataagcagcttgaaaggcgaaggtggtgggcttggcagatggcatgttggacctttgtacatgaaggcctcttccttccccagctaaatttatatacataaaggccgtgatgttggcatcactgctgcagctgagggtcaatgtgggtttggggtttgggctttgtgtgtacttcttgggttttttatttgaatttatggctttttctgaaaccctaataacatgttaaattttcaaacttgagagtagagtgatgagttgactgtaaaagtctggtcttggaggaggacagcatagcagtgtgtgtgcatgcacgtgcatgtcccccagttcagctgctgtccaaagaacccagttgatatgcagtttcacacctgatttggacctgatttgggagataacatttccttctcactttttctggcactggttagtttatctgcttggacctgcctcaagagggcagctgggttaaccaggcagaatatcacccaactctgtcaagctttggccattatctgaccttagactttagtcctgcagaaggagtccagaagccctgtcctacagaaaaatatcagcatttctgaccagcttgtagttaaaagaaaaggtttagtccagacttaagataattggtaacacttaagtagttttgtatgggcctgatctgaggcattgatctaagcccttataccttactcattaaatccacacaaataccctgttaagtaagtactgccattgttgccatattaaagatgaggaaacaggcacagagaggattgtgacttgcctacagctggtcacaggtagagctgggattcaagaggccctcaagctccggggtccacttggaaccactggactctcctccatgaccttggcctttgtcccagatgtagaagaaacacatatgcaggggaagaaaacaccttcagacagtcaaactttgcaaagtaaaaggcccttaactttccataaacccccactgttccgacagagagtccgggtttgtatttgaggttttttgccccaaggaaaacatgtgtctgcctggtgctttttcttctgcttatgagcagacacactgtcccctcccccagtcaaaatgcaaagggaaacatcaaatgcagctgatggaaaagccaggtgaaccatggtgaagatttcagcccactcagagcacagtggccagagagcaaaagctctcctagaggtgagaccttcctgtggttggtgatggagtctcgatggcctggccctgggggtggtgccagggtgctctgtgtcaggcctgggcggatgtggaagatgggggcctctctcaatgctgatctgcaggtgagggggccctccctgaaacctgctttctctgggcctccttggaatgggccttggtggagatctacagacagccctggcccagccggattgaaggcactgtctaattgggagggcattaagatcgttataattaattggcatcccgataaatggcatggttgcctaattggggtggttgctagggaacgaggcctcacttggagcctaaaggggaagaagcgctgggctggccacagttgggtgtcagggtacagatccagcagtgaatggaccggaagggagagcagtccatccgtatctgctggtgtttactgagcagctgctgtgtgcaagttgcaaatggagtatcagttaggggtacttgcctagaagaactgtaaagtaatcaggttcctttctcttgcaagcaacggaaaaagagaagaaaaaaactcaagccagcttaaggagaaaagaagtggacttactggttttcataaccaaaagtcttaaggtgactaactctagcttcagacacagctggacccacagctcagattttgtaatgagaatccattcctatccaccgctcctctgccttccatgaggctgatgtctctccagctctggggcgggcagtccctggcagctgtgggcaccgtggctaggagagccagactgcctggctccctgcccagcagtgggatctggggcatgctacttaacctttctgtgccttgatgttcacatccaacaaatgatgatgatcatagcacctgtctcctgcttgtggtaagcatgaaatgagatgatcaatgtcaagtgcttagcagggcgtctgacccaggtgagccttcagtaggcattgactgttaccataacttaggtgtcaggacagatgtcatggagcagaggggtctcatcccctctggtttaagcccaaaaggaaagaacaagcctctgatctggcaatgcacacctgagccccatggttccctctgattggactgttttttgtccaaaccagtcactggctaaggaaatgagttgccaacaattggcttaagccaggctcacaggcctctccctggagctggatggaggctgactgctgagaccccaaagcctggaataaaacagcacggggagtccccagtgaaagggaagcccggttgctggagaggcagatggccagtgcctgcgatgatgggccactaatgtgagcaatgctggccagatggacccatcttcattttggccaaggtggagactggggaaacacgctgcctgggcaatgcctctcccttccaccagggccaggaggcatcaaaggcctgacttttctgccttactgtctgaaggatggggcctggccttgatcctgtgctttcggggggccaggggcagtgtttgtctaacctcccaccatgagaatcatctggctgtatttgtttaaaaaggcaaagaccagatcctgttgaatcaaacttctagggagggtcctggatgctggggggcatgaccaatatgtcatgtgtatattctatatcagcaggagggtttggcgaagagagctctggagcgtgggcctctttgtcttcctgcctaatgcaggggctgtcagaaggcggggaaaatgctctaggcctggcgtgctggctcatgcctataatcccagcactttgagaggccgaggtgggaggatcccttgaggtcaggagtttgagaccagcctggccaacatggcaaaaccctctctctactaaaaatacaaaaattagccaggtgtgatggtgcttgcctgtaattccagctacacaggaggctgaggcaccagaatcgcttgaacccaggagtcggaggttgcagtgagctgagatcgcactactgcactccagcctgggcaacaaagtgagactcagtctcaaaaaaaaatttaaaagaaaaatgactgcatgatgtgatggggtgggaggcaactttaggcaggctgtcagggaggcctctgtgaggatgtgacctttgaactgtgacctagattttaggaaggagtccgccttggaaagatctgggggaagagcatgccaggtagaaggaacagctagtgcaaaggcccagaggcggtgggaggggcctgtccaagacacctgccccaaacacaaatagaagtcaagtggggtaggccaggcgtggtggctcacgcctgaaatctcagcactttgggaggctgaggcagttagatcactggaggtcaggagttcaagaccagcctgaccaacacggtgaaacctcatctctgctaaaaatacaaacattagccaggtgtggtggcacgtgcctgtagtcccagctatttgggaggctgagacaggagaatcacttgaacccgggaggcaggggttgctgtgagccgggatcacacttctgcattccagcctgggcaacagagtcagactctgtctcaaaaaaaaaaaaaaaaaaagtcaactagggtagagggtcaggagtaagtgggggagggcacgtcagagatgagaaatacaggccatgctaagaaattttagactttattttaaataaaatggataactgtctggacgcggtggcttatgcctgtaatcgcaacactttgggaggccaaggcgggtggatcacctgaggtcaggagttcaagactagcctggccaacatggtgaaaccccatctctactaaaaatacaaaaattagccaggcacggtggcgcacacctgtaatcccagttactcgggaggctgcagcaggagaatcgtttgaacccaggaggtggaggttgcagtgagctgagattgtgccattgcactctagcctgagtgacagagcaagactccatctcaaaaataaattaaaaaataaaatggagaaccattggagggttttaagtcagagaatgatatgatttgtgtttcaagaagatcctgctggctcctgtgagaggcgtgctgtgcagatggaagtggtatcaccgggactgttaggcaacagagagggcccgagagtggcttggaccgtggtggtatcaatggagatggagtgaaatggggattggagatgtattttggaggtagggcccacaggacttcctagtggattggattacagagtgagggaaagggctttgattctcaaccgagggtgattttgacacccagaaaacattttaacactatccggagacagtataggttgtcccaactggggaagggttgctactggcatctagagggtagaggccagggatgctgcttaacctgcaatgtacgggatgaccccacagtgaaaaatgattcagcccaaatattcatgatgtatcctgccaaggagtcaaaggtgactaggcagcctggtgcgtggtgattgctaaatagggaagataggagagaaggttttggggaggaggagtgatctggaattccgacgtggaaatgttgggtttgagatgaaccccacctggatgtctgaaagctcagtgggtggtgaacgtggatgtctgcagccggtcggggctggcaacctaagtttgggagttatcggcatattgatgttattttaagctgtgggactggacacaattatccagagagaatgtgttttgttttctagtgtggttttctccccccagcctccccctagtgcctgtcatgaatctatttgatgaatatttttagcatatcccacatgctcacctctctgacatttccaagaagttcctgaaggctcgggctgagcctccccttcttcatcgcctggtttctcagtgattaacagacagagctaaatattcattgctctgccacagatgcccttgggaaattgcttaaggtcatgtgggatctcgggccttgtaggcagcacgatgccttctgggtggaacagctgttggcatggccttcagagcttctcctccagcccaggccagggcttcttggaattctctgtaaccagaatgttttgaattccccacgttctcttaatgtgattccaaagcacacgttgcccagtggccctggcctctgccatggagcgtcatcttacagaaggcctggcccactgctctgcacacctgggcccagcttgaatcttagataaattctatcccaaactcagagttgttatggccaggtcttgtgtgtgtaagttggtggacagggccatccccagggaccacaaatagtaccaaagatgtgtttggccatgtggaagccagatgtgttaggggaagaatgtggccaatagcttttcttattggctcatggtcaggaccccagcgggtgacttgacccaccccagtagccagagaagaggagcttttttgtttttgagacagggtcttgcactgtcatccaggctggagtgcagtggcacagtctcagttcactaccacctcaacctcccaagctcaagtgattctcccacctcagcctcccaagtaggtgggactataggcacaggccaccatacccagctaattttttttttttttttttggtagagatgagatcttgctatgttgcccaagctggtctcaaactcctgggctcaagtgaccctccaaaagtgctgggattacaggcgtgagccaccctgcctggcctggaactttttgaaaagagattgaaaaaactgttagctcacagaagccttggagatgttcctgcttggtgaaaatcagaccatctgaaagccacatttctggtctgctctcgagacagatactatccatagacttctgattgcaggccacttatctggatatttcagagaccaggaaagcctactataattcttagtagcttagagtcctgatcattttaatgtgaattgaaatggtttcattatgaggaatcacatttctgactgacagtggcttatgcaatagaaacatttaattctcacataacaccaagtccaaagcaggggagtccaggcgctggtttttcagtacaacagtgtcatccaaggtcccaggatctttcaagcctcttcttctgtcctcatcatgtctttggccttgttgcctcatagtctcaatatggctgccacagctccagacgtcgcatcaccctacaaagtgggactataggacaggactccttgctgtctctcttttaatcagagagtaaaatccttgccagaacactcccaccctagcagactttgctttctgtttcattggtccggagttgggttttgcactcacctctaaatcaaacactgggaaaggacctggctccttcctatgcttcggatctcagctgaaatgtcacctccctagaatgctggaaggacaacctgttttatgttttataacacttatcactctctggaattagcctggtttgcttatttgtcctttgtcttctctctcctcactaaaaagcaagctctgtgcttgtagggacattgtctgtcttgttcatcgctgtatccccagcactgagaaccagggtggcactctttggatactcagtaaatttttttttgaatgaaggaagcaagaaaagaaagaggcttggagagctacaggcacatctggctagcatgtttgctcgaaggtgactgctcagggcaaggatgtcaaaacctgttagtcatttgcaaaaagctaagcaggtggctgggaggattggtttcatacacactcacttgctccccagtgccagagctggggttttgtgctagcattgcttgcagaggaaggatcgtcccctttatgccacggcagggacctcacggccttgcagaagggctggtggaaccctccacttctgatgactctggggccaagctagtcttccaggtcagtggtgtgacattctaatgagggctcttgggttaaatatttctgcatgtgcccttgaaaagacaactcccttccctaaattgtcccttcctgaaagaacagcggtcacagcccaggagagcagcctctttaacctccactccccaacctaccctcctgaaagctcacatttaccgagcactttgtacaggctagtggtggtttaagtgcgcgctcctgtgaatgtggaataactcagcgatgtggggatcttccaaccccgttttacaaaggaggaaagagacacaacgaagtctctccttgctctgccatgctggtagaataggacatcacaggccacctaaccaggggctctgttcagctcgcagaaatgttttgtttgaaccttctaaaaagctgtcagatttgtaacaactacgagatttcacattttaaaaatctggattttcagcttctcctgaaaaatggggagatgtggtccccaccatcccctatagcctgacattgtgaaccaattcatttggcttttcattgcactttcccttctgtttttctcattgtggagcaatatttctctgttccatctctaccaaaagtggccagatgagagctggagaggaagtggggtgtggagttttcttatgcgtccacttcacccgtttacattatctgcctggcccacgtaggcatttgagtttgtctcccgttgtgacactttgtacccaatggctacacttccagggacattgcaagtgtccctggacacttacattgtgcattgcaagtgtgtagtaataataatgtctaatatctattgattactttttgcccagcatttcatcatcacagcaagcctttgaagcagggactaatatcatcttcactttatcagtaaggaaactgaggcactgtgtgtgatgccctcactagaacaggaggtcctgaagcttgttcatctttgtaccatctgtgctaggcttactggctgtttgaatgaatgactaaaggaatgaatgaatgatgttctcctccaagtgttcattagccgaagaggctgaaagtcttaacctcatagtcatttgtgacatttctgttgggggaatgggctctgatcagtgtcactgaggattcttgggttgtgtttctgctgtataacaaaccactccaaactcagtggtttaaggtaacaacattttattttggacgattctgtggtttgaccaggtggttcttcagcttcatgtgatatcagctggcaggtctaaaacaaccccattcaaatggctggcagctcttgctggtcaccagatgggagctcagttattctccatgtgggctctgccctatggctacttgggcttcctcgcagtatggcaggttcagggtagcctgacttctaagagtgcaaaaatgaaagctgccacggtctcttaaggcttaaccgcaaaaccggcacagcatcacttctgccaccttctcttggtcaaaacaggtcccaaagccagcccggtttcatgaggtggggcccacacaagggtttgaataccaggcagtgtggctttttggagtccaccaaagtacccattcatcacagactgcaagtagcagagcccaacacttactacctcaagctggaacaggatttactggggggctcaggaaaggacaggtcaggaactgaggaaattctggggaccttggcgcaggagttactagcagcctcctgaaggagagtttccatcccaatgcgacaaatgcacccctgctttttctttctgcccttgacactttatttgacagttggggacatggtaagaaagtctgattgaccttggtcacatgatcaccccttggcagagaggatgggggcatcttggcagaggggagggagtcctcaaaaggaagctggggtgctgtcaaaagaaggggaccagatggacaaaaattgttagaaatctctgcaccgcccctgcataggtgactccacccctggcagagcaatgaacattttaaaacgagtgaatggactttgaaagtccagtataagtagaatgcccaaacctgtgtggcagcttctccagctccagggccccatagctcaggtgctgctgggggtctggaagcttctctccactttacggggcaaagtcaactcctagaacccctgccatgcctcaatatccccctccagaagataggggcagtttgcttctggctcctgaaaggagagcatgcgcggtaatgagggacctgggctcaatgcctgcactccctcctcccagaccccgcctcaccagtgacactgccttccaccccaacacctggtgacacccagtgagtccccgcagcaggggaggctgctagtaggaaaaactgatccagactaatctcagctcgcagagcctctgacccgggctttcctcccacttgccggtctatttccggctgctaattagattgcacagcaagccacattgggaagccgacctgtcgttccaaaggcactccactcgcatctccaaatgtagcaggtgatttggtaaaagttgattctgactccttcccccagcttctaaaataattgtaagtgtcgggctgtttccaaggtgaactaatgaacagctcatctgctaatagcaggggcaagctggctgaggacggcacgctcgcctgtggattgggtgaaaaggaaagaagtaattggattattaataccaagccgtcaaaataccttttattccttttatattcttctggaaggaaacgacaatctctggaaacataaatacatgttctgtgggggtaagcagggctaagaaaatgtggggctgaaaaggaggagggggttaaaaaggtggaattgtcagtccccactgtggcagtctacactgagaaccagcccacagttaggcgtgaataatgactctgttcaagtcggactttattgcttttggccaaaggccttttgcagaaataactttgtaactccctgccagggaagcttttgtccacagctgagacaaaggaacaaagaacagaggtgggaatttctgtatctgatttctacttcctctaaacagccagaaaggacagcgggtgtggcctgcccagaaggcatgggctggggcaaaggggtgtccagcctcctgtgggccacactgccgtgctcggctgcaccatgttggtttcattgtgcacattcccaccccagggcctttgcacttacttcctccgttcatagaaagcattttgcccacaactggcttctcgcccgcctctgctctcagctcagatgccatttccttatgccacctcctcatgccagagaggcctttcccaatttactgtccatcctatcacctgacagcttcctccaaagctcttaagacaatcttcattcattcattttctcctccaccaaggtatcacagctccatgaggacagaggcctggcctgccttgtggccactgctgtttcttagcatgtggcacatagtaggtgctcaggaaagattggatagcttggaagagtcgcacatagctcccaggccaagctccagcggggctttatggagcccgctcagtgcttaaaataggttgaaagtttttactttggaaatggtgtttccggtgtagtccaggcgccaccccatctctatcctaaatctaggccactttactcactcaggtctcctgcccgacccttggatgcatttgcatatttgtccctgctttagacaaaggccactgcaaacatatctctctccaaaggtcaccagacaacatccagacttcttgcattgccaagtcttgtgccagaccggtggcctccaccaaccaggtcccattgactggatcaaggtgtagtcttcatcttagccgtccacgcacagggcgtaagtggcgttgatctcatcataagcaggtcatggcaggaggagggtcgggcaggagacctgagtgagtgaagtggcctagattcaggataagagacggggtagggcctggactacattggaaatgccatttccaacgtaaaaacctttaacttttcctttttccccttttccttttctgctctcctccaagcctctgggtcatcaaggagggaatcgcgtgaactcctcctttatggtcttcaaggagacctactcccaatgtaaggggaagcgcagaggccttggcaagcaagaatgtaaccacaatgtcattgcctttatactgttgccatctaagtatggcaggggttctcacctaggggcagttttgccccctagggggacatttggcagtgtctggagatatttttgattgtcacaactggggtaggtgctacttgcatctcatggacagaggcctgtgaacaccctgtgatacacagcacagtcccccatcgaagaatgatcctgcccacgcggcagtaatgccaaggttgagagacccaggtttatggcaatgggtgctggttcctccaagatagacttttctttctaaataaatttattgaaataagaaagggaatgaatgaatgaatttaggcccagatttgggtattctacttataccagacttttaaaaattcatttatttattctgagacgctggcatatgggatggagcacagaggttaacgatcagccctgtcatccctttcggagcagatcaggctgtaccatttgcctcaaatcaggagcccctgccctggaagctgccatcttgccagaaacttcctggggagctgcctgtaaaaaactctagcagcagttgattctggcccaggtggaaaagctgtgttatcccaggcggagttccggcaggttgggagatgtttccaggtctcctgcccagccaggcatgatgagcatccttccaagcttggccccggagccctggcccagcacccccatttgaagcctgcagagcctcatcatcactgcccccgcccccgccccatcctgccactgacaagccaatacctgcctgatgagaggggctcccagggacagcagccttccctcctggactccagggcaacctccatgttgttgggcggctttgagcacagggctcaagggcagaggctgagttggaaaatttcttgcctctgcagaagggaagagctgggggaggttggggcctttttccccaaacgaggtcttattcttctgtggggttttctgggtttgttaggtggcttcctttctacttaaaaataagctgggagtggttaaaaaatgggaagaaatcaatgtttctggcgtacatagaactgagcagatgtgttatctagaataaggaggagaggttgttgtgactctagctcctggtacgagcccttcagttcaccctcctgccctgctcagaaccccctggacctgacatcgtggctttaacacccttgggtcatgtgagaaggaagagtgcccacccaggactttccgaggctcacagattctttgaaatggacgtgagcacaaacgcccagccccgacagccagggatcagatcgggtttcacttcctaggagggaggatgtactgcaggggaggcccacgtggctgccccaggcctggccagcctctgtgacccagcaggactgactgttttacgggatggccacacggtaccctgcaggctcatccatggtgggaccttgatgctcctttgttgagatgtgggtctgtgtcccctccccttgaatctggccagacgtgcgtagccctggtggaaggaacaccatgggacagcagaaaagatgagccagctccccctggatcactgggaccctcgctgttgtgtaagaaatcagaccccactgcaaggccgccatgctgtgaggaagcccaagccacactgaggccacatggaggtgcccactccgcagcccctcccaagctcccaaccgactgccagcaacaactgccagacaagccaaggccctgctgagccttctcagcagtggcctcagacgttacaaagcagagaccagcccttcctgccatgtcctgcgcaagttcctgatcaggagcctctgagaataaaagaaagattttaattcaccactaagttttgcggtaaattgttacacagtattagtaactggagcattcagccaattccagtcttcccaccgtgcagttattcattcattcactgaacaatattcagaaaccgtccacctcttgccccttctttgctcccacctagtcatctcagtggcctccctgtgcctaccctcatgccctgcagtctgttcccctcacatagtcagaaggattctgttaaaacttacatcagggctgggcatggtggctcatgcttgtaatcccagctctttgggaggctgaggtgagaggattgtttgagtccaggagttcaacaccagcctgggcaacatagcaagacctcatctctaccaaaaatttaaaaagtaatcgggcatggttgtcctcacctgcagtcccagctgcttgggaggctgaggtgggaggattgcctgagcctgggaaatggaggttgcagtgagctatgttcgtgccgctgcactccagcctgggcgacagagcaggactctgtctcaaaaaaaaaaaaaaaaaaaaaaaaactacaccagatcacatcacccgcaagctagaaccccccagcccccttcactcagctccgtgccgccatgcgtgccccctttccggccctccctcaggcatcttcctacctcaggacagttgcgctttctgttccctgtgcctaggatgctcttcccctaaatatccacaaggcatgttccctcccctcctgcagggatccacccaactgtcatctctcaggccttcgctacccaacctatttaaagttacaccccctcactccctagcactccaacctccctccttaggacttgatctccttgggacacgttgcctcatatgttgtgtaatttattttggtgtctgatccatgaaggattgtttttcctgattcccagcactgaagaatagggccgggaacatagtaggtgctcaggaaatctcggctgcctatctggaagaattagcacctcggctctgccaggagctggggccgtggcgtcaggcaaccaagagacagcccctgcccatgcgagcttctggtggagggatgcccctctacaaaataaaaacccaggccaggtgcagcggttcacgcctgtaatcccagcacattgggaggccaaggtgggcagatcacttgaggtcaggagtttgagaccagcctggccaacatggtgaaaccctgtctctactaaaaaaaaaaaaaaaaaatacaaaaattaggcaggtgtggccgggcgcggtggctcacgcctgtagtcccagcactttgggaagccgaggcgggtggatcacaaggtcaggaaattgagaccattctggctaacacagtgaaagcccgtctctactaaaaatacaaaaaaattagcgggcgtggtggtgggcacctgtagttccagctactcaggaggcggaggcaggagaatcacttgaacccaggaggtggaggtatgcagtgagctgagatcacgctactgcactccagcctgggcgacagagtgaaactccgtctcaaaaaaaaaatgaggcaggcatggtggcgggtgcctgtaatcccagctactcaggaggctgaggcaggagaatcacttgaacctgggaggtggaggttgcagtgagccaaggtcatgccactgtactccagcctggatgtcagaggagactccatctcaaaaaaaaaaaaaaaaacacgcacacaaacacaaactcaggccagagagtaaatagaggaatcacaagttatgataagtgctctgaagagagcagtgctgggactgggggtgggggtgaccgagcagggcctgcttcagggacagagggccagggaaggcccaagtcacagccagggtggccgagtcaggtccagaatttgtgattcccacacccacgttccttccgcttttccacactaccttctcttatcagttgtcaaagaaggatgggcgagttggccctcagtaaggcggagagttgggcacaggccaaggaggcctagcgtgggctggtaggccgtgccctgaggcctctgttcacacaggcacgaggtggccaggaagccacgggagtcagccctctgcctccagcccgccccccaatttgggttcatttggttgcaagtgagagagcaactaggaatgacctaattgaaaaaagggaatttcacttctgatcttgaagagtcaaaagtatggggaaactgacctacaaagaaaacagaaactagttaaagaggaatttattgggcctgaaacaaagaacccaacccaaatcttcctctttcaggctgggctggatcccaggtgtccagtgctgttaagtcccaagtatggtgcatttcacagcactgctgtgttcggtgtgttggcttcattcccgaccccactcaagacaaagtggcgtcgctgtcttccctggtcctcacattggaaccacatggagtgagttagccagttgtaaagactggatgcctcttcctgaccagtcaggccaaagggcctggattactctggcccgtcactgaggcaaggggtggggaggctctgattggcccaggtctaggatcccacgatctagcattgtagctccagaactggagcctaatttgaactttgtggaccaagggtggggagaaaaggatcccccaatattttttttttttttttgagacagagtcttgctctgtcgcctaggctggagtgcagtggcgtgatctcagctcaattctcctgccttggcctcccgagtaactgagattacaggcacatgtcaccacacctggctaatttttgttgtttttgagacacggtcttgctctgtcacccaggctggagtgcagtagcgcaatctcggctcactgcaagctctgcctcctgggttcacgccattctcctgcctcagccttccaagtagctaggactacaggcatgtgccaccacacccagctaattttttatttttagtagagatggggtttcaccgcattaaccaggatggtctcgatctgacctcatgatccacctgccgcagcctcccaaagtgctgggataacaggcgtgagccactgtgcccagcctaatttttgtagttttagtagagatggggtttcaccatgttggctaagctgatctcaaactctggacctcaaatgatccacctgccttggcctcccaaagtgctgggattacaggtgtaagccgccacacccggcctcagactcccaagaaaattgggagctgttatagaaaggagataatcctgggtggcccaaacctagcagagaacacaagccagcatttattgggcacttgctgcatacagatctgttgaaagtctccgtgcatgttaaaccatccactctgtaggcaagtgcttgtaggtgtcctcactttccagatgaagtcactgagaagacaagaggttcagacacttgcccaacctctagtaagtgacggagctgagatccaaacccaggcaggctagctctagatcctaccctcctcctactcagcgtgttccctgtggcattttcccccaagtaagtatcaggctgtttgcttacctctgtccgctgtttgtcagctctctgagaatcgagagttttgtctgttctttttttttttttctactgatcatgaaacagtacaaagcaagtggcagatgctcaggtatttgagggtgtgaattatatggcctgtcaaacatctacccacttgacatacaaaacattttggtgctcagcttcctaagacttgaatacattgtttctaaatttcctttgtgctctaactttaatccatggccactctgttctcacagcttgccggtggtttgccattatttccagtcctcttttctgatcattctcacatgtagctggaatctttcaactccagcttttcctatgttgacttagagtatcacttccaggagggcagggagctttcttttcactgctttatccacagtgccaagaactgtgcctggcacacacgagccttcaggaatgtcttgttacatcaatagttaggcaggtaactgggttcctaagccctgcatttttgccctacaatctttatgccctaatttcctttccagatcctgagcctttgtcttgaaacctgatctttccctcctccctctgaatgacccttctattgtctcctgccctgttcttgagagccggcttggttctctgcctccatttggaattccaagaacaggcaaggagagccacaagatggcctgggctaggtaggggagacagggagaagctgtggcccataggttacaggagcttctgtcctttctttgacggccccaaagaggaggagagaaggctggagaaagcctgtagccaggaagaaagggagacacaggggagtgtaaagtttaacagatgtgcgtgtgtcatcccctgtctagacagcttctgggcttgtgaggtttgggaccacactttcccatccctccaggggcctctctctgtttcctctgcctgctctttgcccaaactgtttctcctgcctgaagcatcctgtcctccaccctcctcttcactggccatccaaatcctttggattcttcagaactttgctcctgttaggctgctcagtttatgctaagtactcctccaggaagccctccctgactgctcccaggccagcagtttcccctttcctcttgctgtttatacaacacacttaacctcagtcccttgtatcacttgttgctttccaagtcagcataagtgtcaaaagagtaggctctggggtcagaatgtctgtgtgcaaatagccatgctggcttgcttgttttgtctgtcacttggaggtggcacatccaagtgaacctcccaggggacagggaagagtggattactgttgtaatcgggcaggattctcctatcactgaacactgcctcacatatagcaggcccttaataaatatttgtaaagtaaatgaaggaagagagaaatgatcaggctccctggaccacctgaggaggccctcaggtctgttgctgggctctggccccagcccgtgggacatatctgcacacccacaatttcctttcttccctcctctcatgagtgtttcccgtctgaccaatgccgccttctgcctctggccccttcttcctctcccaccacctcaactgcctaattattaccaaacttctctctcctgtttttttttttttgttttgttttgtttttttttaaggcagtgtcgctctgtcacccaggctggagtacagtggctcgatctcggctcactgcaggctccacctctgagttcacgctattctcctgcctcagcctcccaagtagctgggactacaggcgcccgccaccacgcccagctaatttttttgtattttttttagtagagacggggtttcaccgtgttacccaggatggtctcgatctcctgacctcgtgatccgcccgccttggcctcccaaagtgctgggattacagacgtgagctgccgcgcccagccctctctcctcctcttgttggatttggaggtggagagaagatgggaagggaggaccaaagggacagtattcagcacccatgctgcacgacactgggcaggttctggaacctgtccgtgccttatcttccttgtctgtaaatggagcatcccaactcacaaggtggttgtaagggtggcgtgaggtcacacactaaaagtgcttagaattgtgcagggcccctgatgttagctatcattcattattgttcttctagggtgtttcctgtgttggtctgggtgctccctgttgcaaatgacagccctaattcggactctcttaagcagcaaagggcacttttttgagtctgtacctggctacaagatgcaacttggtccaccccattgtcaccagcatcctctctctcgggctccatccaatgggcggccaccatcagcaccatattcatgcctcctggcacccagcacagtctcctccagcctccaggactccctctcgcttattggccagacttgggtcacatgtctgccccaggaccaatcgctgaagctagagctggaattgctgattggctccacctggctcacatgcgctgccctgcagtcaaaccatatataagggggggtgggaaataagagcacttgtggcctcaaagcactaacaggggctgttaccaggagacaggagataattctttgttaagccagtaaatattttgaatgcctgctatgccgcaagcattgttttaattgttgaggatatagatctgaacaaaaatgacaaaaacctgtaccttcagggggctgatattctgctggaggacatccgcaaagaaataaaggagctagctgtgagaggtggtaagtgctactggggagggcagagatttcggttttaacctgccaaggtgaaatttgagcaaagacctgaggagggggaagaagggatggtgaagataacctgaatgaaggctccaggcagagggagcagcaagttcaagggccctggggtgggctgtgctagcatgtgcaaggaacagtacagagaccgtgtggctggaaccaggtgtgcaagggagagaggggaaggcaataaggtcggagaggtgatggagcaggttgggtgggttcttgtagcccctttggagggtttttgcgttttactctgcgtgggatggaagttattgaaggccgttcagtggaggaaggcaggcccttgcttttgttttaacaggatctgtctggctgcttgatggaagggacgaggtagaagcagggaaaccagttaggaggctgttggaatccaggcaggattctcctatcactgaacactgtgcctcataggaggtccttcatacgtatttgtaaagtgaaagaaggaagagagagaaatgatcaggttctctggaccacctggggaggccgctaggtctgttgcggggctctggccccagcccgtgggacgtatctgcacacccacagtttgctttcttcccgcctttcatggacatttaccatctgaccagtgcctccttctgcctctggccccttcttcctctcccaccacctcagctgcctgattgttcccaaacttctctctcctcctcttgttggatttggagatcctcagaggaaaacagcccatctgggtctttctaaacaggtctggatgaggtcccaggtgtttgttcaccgctgtggtttgtggcattgggaaggtgagggcatcagtcactcagacccgttcctcttggcagatcggcagagaaattgagaactaaaaatgatgtttctaaatgctcaggacgttagctgtttccagagatgtctcctgggctggcgagcctttgccaaggtcctggagaagactcaggatggagaggaggagccagagagacctggaaaggaactggtgggaaggagaggtgttgtccacagcagggatggagtggcaggcggctggtgctgcgtgagttcactgggtgctctctcggttcagccactttgaatattttaccaagaaaaaggaaaaaaaacaaggcagaatcccttgtgtcatctttaattgatttcttcagcatccggagagaaactggcatgaggccacgagaagtctgagccaggggaattcatcagaaatcgacccactgatgacttgatctgatgaaataattagctcctgttattctctggcttctggtgccggagctttgacttccatccagaggagagcgggtgatagccgcccaggagtggggggtgctctgaaaccaacatgggagccaggaacgaagtccagctgactgtgccccgggctccatctttacccagcccagggctcccaatgaagactgcccttcccagcccccctgtaccctggcatcacaggcccagggccaaaaaggccctcagagggcacctggccacctggcaaatgaggaaactgaggctgggagactcttaggaacttgttcaaagatctgcttctagggggtcctggttgagctgcccaaatcgggccagactaggtttgaaccccttctctgccacttacccatatgatcgggggaaagtgattttaactctctgtgcctcagcttcttcatccataaaatgggtgaaatattgatgggtgggtgtgcatattaattgggttgacacctgcaaacagctcagagcagagactggagtgtgctgcaagctttcagaaaggttttcctgtgattggtttctggtttcagagagttgctatttgtagggcaccccatcggaattctcccaatattagcactccacgtctgtctctctgaaggaacgtgaatgtgcatcttagaacgctggctgctgcaatcgtagtttcaagtgcaaagcatcccgtagtgtttcccgatggagggacatgggccactgataatgtattagtctgttttcacgctgctgataaagacatacccgagactgggtaatttaaaagaaaaagatttaatggactcattgttccatgtggctggggaggccttacaatcatggtggaaggtgaaaggcacgtcttatgtgatggcagacaaaagaagatgagaaccaagcaaaaggggaaaccctttataaaaccgtcagatctcatgagacttattcactaccatgagaacagtatgggggaaccacccccatgattcaattatctcccaccaggtccctcccacaacacgtgggaattatgggcgctacaagtcaagatgagatttgggtgaggacacagccaaaccatatcagatacacaacatagtttgaggattactctgatttggggtggttcagggactgattcgatggctagagtttgtctccttttcagctgtctggcagcctccagttacctccagcagaaagtctcagatggtgctaatgtgctttgactcctttcaacacctgctaatctcacttcaaaagagagtgcgagcgcgagggcacgcgaagcctgggaagctatttgcatcaagttccactgattcagctttctttgacttttatttgtacaattagctctacagggaagcgatgtccactttccatttatctttgggtaggaagttttcttttcccaaaacatgtgtttgtgtttttattttaaaatgaggccatttaaagaagcacgttaagcaaataatcactgaagggctctgcagattcagcagaaatcagggccgtggtccttgaacggaaagagttgggaaatccgagtttcgtgatgagaagcccacattgaacggtgagggagggcagaattcacatcccatccctgccatcttctgtctgggtggccttaggacagtaatgaaacctcagttttctctggggctaataatagtacttgcaggagggagccttggtggaggttgaaggagatttcagagtgcctgacgcaggacagctgcagcggtaggatcactctaataatggtttacattgtggaatatgtatcccagttagtactatggccaggctctagtcccagcacactgtatcaacacatttaatcctgcacacccatttcacagatgaggaaactgaggcacaaaggtgttaagttactagctcagggtctttcagcaagtaactccaaagtccacatccttaaccatcacaccacgtggcataaagcaggtgcccagcaggcagttgccgcagtggctctggctgtcatgaggtgtatgtttctgcagacgagagattgagaaggaaggtgttgttcaccctctggtcccatgaaactcacagttctcatgtcagacgactgcatcgagtgtgtccccagctcccctgaaattgtgactctcagagccacctgggaaggaggcattgagcggagcctgcttcctgctcccaggggaggtgctagaagggagacttgctgtcctggccagcctgacataggatacaggtccctgaatgaagtaaattagggtgcgcatcagggcagctgggagagttgattgaaagcactgttttcagaggcaggtgggcaaagggagcaaagaaatgatgctgcaccgaggaaccggtagcaacaggagcccttactttcccgagacttgatggggcaagaggagggagaggtgaactcagaactggggagacgctagagccaggaggggccccaggcaggagctgcatccacacacacagacacgaaggctactgcctggggagctactgcgtgcgggaggagaataaatgcacggacttcccaccacctcccatgctgcagcctcccagccggaagccagagagcagggacgtgccgaccgtgccatctgtagagctcagcctcccagggtgccaagcagagctgggggagaaatggagcaggagtgacccttcctggggtttttcaaccatagcgctgcccagagaacacagtggccagctcctcgttggtgtccatggagggtggctggggcaaggcatcagtgatggacgcctctgagccatgtagacccaagctatggcacggccctgccaagtccagcttccctcactctgcagaactcaaaggaccttagcagaacctccgttcctttatttatctatttctttgtgccaaggcctggagacagccatgaataacataagcctgtctctgtcctcagggagctgaccccctagtggggaagaattggacaataaataagaaattgcaggctgcagtagtgattacaagagaaataaaaccggttataaaatgcagagtgcctgggttgggggcccccgctttaaatagggtggccagggcaggcctctctgaggtgatgacgtttgttcttttgacagaaagagccaggagtacaaagcaggagtttgttgttgttgttgttgtttttgagacggagtctcactctgtcacccaggctggagtgcaatgacatgatctcggctcactgcaacctccatttcccaggttcaagcgattctcctgcctcagcctcccgagtagctgggattacaggcatgtgccaccatgcccagctaatttgcgtatttttagtagagatggggtttcaccatgttgatcaggctggtctcgaactcctgacctcaggtgatccacctgcctcagcctgccaaagtgctggaattacagatgtgagccactgcgcacagctgcgggagttatttttaaaagagcaggtgcaaagaccctggggcaaagagaagcttgacttgtccattcgacagaaagaagccagtagggctggaaaggagaggtcgaggagaagtgggcaggggccagatctcacgggccagggcagccctggcaagaagtttgcatcttatcctgtgagccatgagcagccagggaaggtgcggcaggtgagcacaggactggcactaaggtgaggcgagtgcctggcacttgtgcagcctgggagcgagcacccccttcagtctgtacctgcacgaggcactgtgccctcccctgcccagtgctgtgatctgatctgtattttaggaagattcctccggctgccctgggaaaatggaggatgggggcagggaagagggaggcgggagacccctcaggccaccttgcagtccccaggagagatgaagcaggcagcacatccccctgctgaacccggagaccttgctgagcctctgagtcatgactttgagctgatggctggggttccccatgaagggcaaggacaaacagaccctttcaaggtcacagcaacacagccacccccacagcacttggcttcctcccggcacatctgcaggctgtggctctctcgctcatgctctcttgttttaaataaatgataccaaaagtctatatctggacaggacttgaaggctcatttcctcaagaagtgaaaaaatgaccacggagagcaaagagcagggcgagattagagacctgcttgagccagagtcgcgtccccacctccccgcacccaccttcgctggtgacctagtctgacctggggccaggggggtgactgagggcacagtggcctgtggcaggtcttccccctccaccttttagcgctcaattttctctattgtcatttcatttattctgcaacttaaaactaataggctgggcacagtggctcacacctataaccccagcactttgggaggccagggcaggtggatcacctgagttcaggagttcaagaccagcctggccaacatggtgaaaccccatctctaccaaaaatacaaaaaattagccgggcgtggtggcaggcgcctgtaatcccagcttctctagaggctgaggcaggagaatcgcttgaacaccaggaggcagaggtcgcagtgagcccagatggcgtcattgcactccagcctgagcaacaagagcaaaactctgtctgggaaaaaaaaaaaaaaaaaaaaaggaatacttttttgcccaactacaagatcccttaacaaggggctttcacacgcatccccagcagactgaaatcttacaacagccctgtctactcattttgttcatggggaaaccgaggttccaaacgggcttgctcacgggaaaactgagccagtgagtggaagatctgccactcacacatgccagttgtccagcccaaaacatccagctccaggctctcgtttaaacccctgattgaatcccccgctgctggggagctggaacttcatctccctcacctctgtaccccacggtgcgggcagatgcaagaggacggcaaatattcaccccttgagaccagcccgctgctgttcctctccctggggacgatttgtctgtggagttgggtggattattcagagacggctgttatctgactcgggtcttgggctgccaccgacacatcagaggctcactggatccagggaagaaattgtttctgcagaagtggccacagaaggcttttctgccagtctgttgaccaagcaaactgtaaagactttgctaacttcagcggagttcggttttcactctgccatagccacccctgttcaaagaaactcccattgttcatgccagccgccatacaaatcattatgcaagaatgagcagccggcagccttgacataaatattgacctgattcttcctcctcctctagatctgcgagtgaagagggacgagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggtaagcctcggggccccagggtggcacctcggcccctcggagcagggtccctgggttaggctgaggctcctgaggcaaggcggtggtgttgatgcgtcgtgctcacttttgagtacattgaaaccaagacacgggccacccacacgtgtttggggtcacaactgggtcctcaaggttaggggtctctacccttctccagttgcacaaccgttcctggatttctccaaagagttaaagagaacaggctgggcgctatggctcatgcttgtaatcccagcacgttgggaggccgaggcaggtggatcacctgaagtcaggggttcgagaccagcctggccaacgtggtgaaaccccgtctttactaaaactacagaaatgagccaggcatgatggcgcacacctgtaaccccagctactgaggagactggggcacaagaatcacttgaatccaggagaaggaggttgcagtgagtggaggtcatgccactacactccagcctgggtgacagagtgagactctgtctcaaaaaaaaaaaaaaaagatgagacatgagcctggagccaaattttggaggctcttgtgggttgtggcaaagactgtcaatcattgatcccgtgaagggtgatccctcagcctctgtccactcttaaaggataacagcgtgttgttggtggcaacaaatgtgaaggttgactaggttagccttgacaacctgaatttgtcttttagctaccaggaaaaggcaatttacataaaaccaagttgttccttgcaatgctttgtattaatgatcacaagtatagtttttttcctccgggagcttctcagtgcagaaagaatttgtagccaggaagcaatcagagcccagagcttttattgacaatttgacacataggatacctatctcctggcagcatttagaatgaggcgcatttgataactatggggagtctgcagactgtggccagagaggtgtgtttcgtttcttgaagaattttgcagaggggtcttgcaggcagcacctggacctcagagcttcttggtctcacattgtgtagccccgacgctgtttcggctatagtcatgcttagaatttccgatgccctgcacgtttgttcattcatccagcagatgtttattacgcatttgttgcattcagtgcactgtgtcaggagccagagaactaagggaggctcattccaggtgaggagaacaggaaattcaaagatactgagatagaaatgggctcggtggtttggagcaaaaaaaaaaagtgccagggagccggagtggagggagctggggccgtgatggagagagatgaagctgaggagctgacttggcccgggttgcaccaggccttgtggccatggtgggggctttgagtttgattcttagtaaaatagacatggatgagggggccttaagaagaggaaggccgtgacctcacttaggttctaacaggatcccccagctcttttgatgaaattaaatcgcaggggtaagggcagaaacaggacactcattcagaggccgatggggtgatagggcagtgatgatggaagctcagacccgggtgctgagatgcggtcccacctgatgtatatttgggaaataaactgatcaatgggttaggtatgtgggttatggaaaagatacgtttcaagggcagccgctagatttggggcccgaatcaacaggtgagtggctgaatacccactcttaggaacaacacatttttgcaacatgatccagctaagtctcatgtctgaatctgactgaattttgcatctgtgacttgtgaataaaaccaacagtgtatgcagataaaaagaaagcaaaggcatatgcagatataaggaaaccaacagcgtatgcagatacaaggaaaccaatagcaggtatgaagtagacacaggagagaggggaacaaagaaagccgtggctgacttaaaatacagagatttcttctctccatttgacagatggaaaaactgaggcagagagaagtcacttgtccaagtttgcacagctagaatgtgattaaacatgatttgagctgggtgcagtggctcacgcctgtaatcccagcattttgggagcctgaggatcacttgaggccaggagttcgagaccagcctgggcaacatagtgagaccccccccgtcttaacaaaaaatgtaaaaatcagccaaggatggtggcacacacctgtagtagcagctaatgggaggctgaggtggaggatcacttgagcccaagaggtcaaggctgcagtgagcctaggtcacaccactgttctctagcctgggcaatagaacaaaaccccatcttagaaaaaaagagaaaaacaagatttgaacccagaacgcgtgatcttagccactgctctatttagccagattcctgggatggatattgagttgttttcagattggtagcgtgtgcgtttgttagtttttcactgttacggatattgttgctggaaatttaaacaggcatcgttgcacagacaagggagtgcttctgaaggataaattctaggaggtggatgcggtgggtttagagcccctggtgttcagtggcctgtgtcagctcttgcccaatagcactacacagcatagattagggcctacaagtcttgccctctataaacaagccagacctcttccaccagcagcactgggttttgaaggaggcaagggatgggaaggtggttgtgggaggggcatgataggctttttataaaccactagacagacccagatcaataatgcatgtcccaaaaaagcccaatacattatctcacagtctctgctacaactggcatgcagcgggtggtcctaaaaaatttatcatttgctattttctgcccatccgtgcagcagttctgacagccctctgggctggagacttcttgactgagataatcccaggattctttccagtcccaggacagagaacagacgtccatcctcattagggtccggttgggaggactggtgccagatacacaagacgaggggcttgttctgtttcctaattgcaaggttggggggttcggggctgtaccacgtatattcaattttcctttccctgcacgcatttgactccctaagctgtcatttggaattatcaaatgcccaggggaactgcttccagggccatactagttcgtaagtggcctaaattatcattacatgtttaaagtagttggggacatccctgtgtctcaatggccctctgagaccaacggacttttgctggacttccgctccaaaagaataagagggaagcacatggaggtaaaggtctcgtttgcagacgtcctttgttcagggaggcagtagaatctttgggctctgccagggtttactgatttaatttgatctaaacctctggggagcctctggggctccagcaggctctgagacagcaagaggattaagacatggttctggcctggagcaagagaatttttgcagcatcccagttctgatctatgacttgagaatttctttaactggacttatttttgaagcttaaatattattttaaaaggaacctccaaattctgactgtaaaggaaaaaaccaatacccattgccttcggcaaaggatcactgtaaaaccaaacacagtgaaaaccaagtcgtgtttttaaatttcagcaagatgctgcctcccagaaagccagtgtgtctctactgtaatgagggtgacgggcagtttcagaagcggcattaaaggtgaagtagcacctgccaagactttcttcttggcctcatcagcaggatagagactagaaaagagaagaactttctcaagcttttgatgtgggggtcccacttacatggggaccacttggtggtggctcttgtatcagagggttaaggacacagccagactccaaaccccagaatatcagagcggattccccagtgctcattttcctgagtgttcacaccaggcagagatgggtgccttttcgaggcccctcagattgtcggatttgaagtgtgccccacgagactgcatccagtgtttgcatttcttttcttttctttctttttttttttttttttttttgagagagtctcactctgtcacccaggctggagtacagtggcgcaatctcggctcactgcaacctctgcctcctgggttcacgtgattctcctgcctcagcctcccaagtagctggaattacaggtgcccgctaccacacccagctaatttttgtatttttagtagattcagggtttcgccatgttggccaggttggcctcgaactcctgacctcaagcagtccgccgcctcggcctcccaaaatgctgggatcgcaggcgtgagccaccacacctggcctgatgtttgcatttcaaaagaattctttgcctctcagaacatctttatttttatttgtttatattttttgagacggggtctcgctctgtcacccaggatggaatgcagtggtgtgatcactactcactgcagcctcgacctcctgagcttaagcaatcctcttaccccagcccccgaagtagctgggactacaggtgcgcaccatcacactcagctaattttgggagtttttggggttttttttttttttttttagagatgggcttttgccatgttgctcaggctggttgcaaactcctgagctcaaacaatccgccccccattggcctcccaaagtgctggaattgcaggtgcgagccgctgcacccagcctatcagaacatctttaaatgaaaatactccgagtaaagttgcaagggtaagagctgtctcattagccaccaggttcaaatcctcactctaccattgaccatgtgtccttgggaaagatttgccctctctgtgcctcagtttactcatctataaagtggagatgatgatctgtttccctggcattcttgtgaggaatacctggcacctgtcatatgtgtgacagtttgctctcacttgggttgttaaagccatcctctgttagagcaccctgggccaatgccacagtgttgtttgtctacagcaagctttgcatatcaaaacgacattaaaatctaaatgtctcatggcactgaacagcaacattagagtctcctcccagctgacacagtggggtgagtgctgtccacgctcatgcaggtgagctggcacccactctgccaggtatgtgagcctggcatggttacataccccataatttgagtgacacttgtcaatcaagtttggcatgggttcttctgccattactgcctctgctgatgaacagagttgcaccatcatggctgttgaaaagcaactgagtggtggttttggggcctgcaaaagtgccatgggaaccagccttccactgggtgttaaaaacgcgtgtgtcacaaccactctctgtcagcctggattctctcagttacgagtgatgtaaacccaactcgagcaggattgaggaatcaaaaaggggactttattggactcatatgaataagtccaagtatacattgagcttcaggtgcggctggatctaggagctttgtctctgggtggcctctgtccctccatctccctgacctcagctttcctccaagttggctttactctcaggccagctctccaggcagcattcctggcatcactagacccacatgaacaccatacaggtgcaagccatccctgtggaaagagagcttctctcacctagaagagagtacccaaattgagtctttttggtctgacactgtctgggacttctggtcaaccagattcaggggaatggaacacagtggttggccagatggagtcaggtgcacattcctggagccaggactggagccaaccccacttgaaccatgaggactgggattgggatagagcagattccccaaaggaaaattcagaagctagtgccagaagaaggcaggtagctggtgtgcagtccagttagagagatgctcgtgacaccctcacatggcgctctctgaagcagctgctcaaactgtggaccagacttattcattcggcaggtgtttcctgagcacctactgtatgccaaaggagatccaacagcaaacaaactaaacagagcttacattctaatgcaagagttaacaagacacatcgaatctatagtacataaaagagcagaaagtgaggaggagaataaagccaggaggggaagccaggaggggcgatcaaccaggagaaaggtggagaaaagaatcgctgggattttctatagggtggtctcattgggaaggggaaatctgagcaaagaaggtaaggaaaccagtcaagggggatccctggggaagagcactccaggcagagggaacggtgtgtgctaaggccctgaggcagatgcggtctcagcaggctcagagccgcaaagaggccagagcagcgtgcacaagagcagcaggaagaatgaacggtaatagggaggtggtggttggatggaccgtgcaaggcatgagcctttgaatgggaggaagattttggctttctgagtgagatggacaccaatagaggacattgagcagaggaggacattgagcatctgatttgtgtcttcataggacccctctagaagaatagactgaataggtgtaatgagagcagggtgtccagtaaggagtctactgcaacagtccacgcatgagatgagcccaatgaggagtctattgcaatggtccaggcatgagatgatagcggttcagaccagagtgaggaaagtagtaagtgctggtcatatttcaaaggtagagctgatacaagtgctgatggaactgatgagggatggtaaagaagagttgagaatgactccaaggttgtggcctgaaaaactatgagaatggattttctgtgtacagagatggggaaaaccatggttagaagctgtgggccgggtgcggtggctcacacctgtgatcccagcgctttgggaggccaaggcacgcggatcaagaggtcaggagatcgagaccatcctggccaacatagtgaaaccccatctctactaaaaatacaaaaattagcggggcatggtggcacacgcctatagtcccagctactcgggaggctgaggcaggagatttggttgaacccaggaggcggaggttgcagtgagctgagatcgcgccactgcactccagcctggcgacagagcgagactctgtctcaatacatcaataaatcaataaataaagctcagttctggacctgggaagttgcaggtgcctgtgaaaagccaacaggaactgtccaataggcagccacatcagtcagacgttgaagagagaggcccaggcctgggtggacttagagtagggcacggtggggatcgtatacaaactgtgtgcttgtttgtgctttactgaatctgagaccctccccagatcctgaaagttgcaggaatacagcctggagaactgtccagtgggagaggcaggcttttgaaagaaagatgtagcagaggtctggccggcctcctgttttccactttccatctgtgaacacaaggaaaccacaccctgtgccacagcctgatatccaggagatcaattccaaatcgcaggctcaagtactctctgtaggggccagatggctggaagcccaggacaacatacccagattccagacaccagatcagtggtaacttccagctcagcctctctgagatcccacctcctggccttctagccgctgatcactagaggagaaaaaacatgtggatgcaggttatctcaggaagaagagaggctcattcggacccacactggtgttcagcttgccaagcacattcctgtaagatgattttttttcaattcagcaacatttgggagatcacttgagttctggaagttaagtgtatcaggattaggtttggctgcatgtaaaagaaaacataaaataacagtggcttaaacaagacagaattatacaaatgtctggaggtaggcagtctagggctggcttggtggcttcaaggttatcagggacccaagctccttctctgcctttctgttccatcatacttactgcgtagcttccatctgcaaagtcaccttgtggttagaacagctgctggagctccagctctcatagccacactctaggcagcaagaagaaggaagcagaggcagaagggcaggaaaaagaaaaaaaaaaaaaccacttcagaagtcacatgcaacacgaatagatcttatttacttagccacatgatctcagcgagaattataaagcacatgcaaatttgaatcattggaagacggtttaagtgttttttgctaaggtgtgagcaagtgcgaggaaaccactagggatagggcagtgccccaggctaattagcaacagtgggacaagaggttactggaacccagggacacagagggtcaccccacaagagctgtcaccctctgttggcaccacagagaggaaggtggaggaatctgtccaccaacctcactctcttctttctccgatctcctgccaggggcccttgtcagtcaaatccaacccaaagcccagagagcgaaggggcttgttgaaccagcacctccaggccagtgccctggggtggagaactggacagagagcagggctggaaggcggcaggcaggctcctggcacatctttggccataagggaatctgggaaatgtttcctagctgggtgcattgaaaataaagtcacagcctgatcagaggaagaaggagaaagagatatttgtgggcaactgagggtctcagcaacaccagagatcaggagcaagggtcccagtgagggcagctcccctagcagtgggaagtggggttgtgtggcctaacactggggagacctgtgtcatgaggagacattcatgtggaaacccgaggcaggagcactgcaggcagaagcacggcacgtgcaagagccctgtggcaggaacaggtttcccaggacgttggaggagggcagcaggacatgggaatgaaggggaggaggatggggaagagggcggcagagagcagacaggggagacctggtggtccccagcaggccatgcagcagggtctggatttgattgcatgcccgatggaaggtccccagaatgttctgagctggtcagctatgcgtgcatgttctcagaggcacaccccggctgtaggtgaagagggtggcccagggacaagagcggaagcagggagatcaggtggtgtttgcagcagtccaggtgggagatgctggtggtacggagcaggacggggcactgcagagcgagagaggtgggtggattccggtgctgcttggaaggtcggcagggtttgctttatggatcgtgagtgggtgggtgagggaagaggaatcggggatgactcctaggtttttggctgagccgttgggcagatggcagtgccatttacagagatgggaaggcgggggcaggaggaacagattgggagaggtggggaagggggggacattaggttgctttgcaaacatcacccaccaggcctgtggctgggcagcagctctgcgtagccccttctgaaaagtggggaaaacaccctggaagccctgccccattgaataaatatcccctcccagggatggtgattgtagcattttgagttagaggaatatttctgggtggagtttctcagagaggaaatgaccaatcattgcagagcctcgtcaattacacccaagccctgccctttcccacgtgtgctctgccacctctctgctatggttgacgatgaccatagcagaattttctcccaggaacttctgcaaccagaggcagcagaaagcaacggagaaaaaattaactgcatggtctctctgacaacccgatgcttattaatagaatctcagtcctgcctcctcgacatctgcctaattgattttgggtttaggaaccgatttggagccttggcttttcgtagctgaaaccagcaataacatttgtctttattttgtaatgtccaagagtcaggaatggttcacctttgcaccaacaaaagaaaaacaacaacctctgagcaacaggtctccagaatccagtgtaattattctggattgagttacaggcacagcaagagttgccaccagcagcagtgagcacatctatactaggtgaaaaataagagattccctttttatgtgtgtgtgtgtgtatatatatatatatatatatatatttttttttttttatttatttaagttctagggtacatgtgcacaacgtgcagttttgttacatatgtatatgtgtgccatgttggtgtgctgcacccgttaactcgtcatttacattaggtatatctcctaatgctatccctcccctctccccccaccccacaacaggccccagtgtgtgatgttccccttcctgtgtccaagtgttctcattgttcaattcccacctatgagtgagaacgtgcagtgtttggtcttttgtccttgtgataatttgctgagaatgatggtttcgagcttcatccatgtccctacaaaggacatgaactcatccttcttttgcccaagtgtggctcccgatttctgctgtttgtgccccaggcctttctctcccctctgctggagacagagctattctggggcagttggtcaggtctgatggagcccagcctgctgcagcccattagcaggtgttgccttggtcatggcagggagctcacaagctgatcctacagcactgcggacattccagggacatttgagggccaggagagggctgctgaatgagttccagcctgttaggtggacaccagtagccagaggtcagtgcaggacacaggttctttcccgcctgtggctcgacctcatagccctcttcatcccccacctgtccaggtcaagactctgttccaacctgtacctgaccccacagcctctcttccccactgaatgcctgttctctgcaggtctctgggccccagtagagcgttacctttgcagatttatttagctgctcccttcacttggaattgaatcagctaagggttgcaaactccatgcccacagggctaggcacgtgctggcaaggaggaagtcggcatggtaggggtggtggaagaccagaggaggaccttgtcaagtgggccttcgctactcaggtccagcccactgtgggcccatcaaagccaggtctttgcatttttcaagcaaagccagaaagctgaattgatgtgaaatctcgcaattaaagaaaaaggccattcaatttttaaaatcctttccttttgggcagacctaaatcaaacacacatgcagacaagatttagtctagagggactccgttttttaactccgcgtgagacgatacttgttgaaaagctgacatgtggccgggcacagtggctcactcctgtaatcccagcactttgggaggtcaaggcaggtggatcacttaaggccaggagttcaagaacagcctggctaacatggtgaaaccccatctctactaaaaataaaaaaaattagccgggaatgatagtgggagcctgtaatcccagctactcaggaggctgaggcaggagaatcacttgaacccaggaggcagaggttgcaatgaaccgagatggtgccattgcactccagcctgggtgacaagagagaaactctgtctcaaataagtaaataaataaataaaagctggcatgcattaagtgctttctgtatgtcaagcattgaactaaaaaagtgtgtgtgtatgtgtatatatatatatatatatatatatatatatatatatatatatatatttttttttttttttttttttttttttttccctcaaaactcagaacaaccctgagaaggaggcactgttattctcccgctttgcagatggggaaactgaggtgcagggtggctaaatcatttgcacaaggtacctggttaataggaagtggcagaaatcaagatttggaatcaggccttctgactgaaaacctttttcatcctattgagtatggtgacatagcgataggttctagaatctatcctagaatttcatagtcaaaccttatacctaaagttatttatgggctgtgtttttacagacagggaagctgaagctcaaagtcagtgatttacggcagttcacacctcattcttggcctctcaattcagtgctctttggcacccaaagtctacagatgaaaaaggacctggtgattcagtctaggactgaagtgtatatgtgcatctgtttgtgtgtgtgttatacacacacacacatattcatttgtagcagctgaacccttttaacatacaaaacaaaacaggtaagagaggaatcaggagaaggacgcggcctggagaggggtgtgtggtgcccccttcatcctcagcctgccccatgccaggtggactttaatgcccctctcctcaaggaaagaaagcacagcttgggggcccctgggagcagactggccccaggtagagtgtagcaggtgatatgtggccacaacagtggccacagtggataacagtgttatcccaacactgggaggccaaggcaggaggatcacttgagccctggagttcaagaccatctatagatttttcggtcatctatagaaagcccactgtgtgccctcttcccctaaatcccagggcctgcttcacataggggtagcacacagacaggcctgcagacccgtgcaggaatgccaagtgccaaatcctgccctctcccattgttctagaaacctgtggccctcttgctgcatttatttattttttatttattcaggagttcaagaccagcctggtcaacatggtgtaaccctgtctctactaaaaatacacaccaaaaaaaatagctgggcatggtggtacttgcctgtaatcccagctgctcgggaggctgaggcaggagaatcgcttgaacccaggaggtagaggttgcagtgagccgagatcgcgccgctgcactccagcctgaaagacagagggagactccatctcaaaacaatcaataaaattacacaagcaaaactttaaaatatccaagtaatgcaaagcagagatagcccttgactccccacccaccgtgtaccccactcaccccaaaggcacctgcatgtcccctaagaatctgtagcctgcatgtcccctaagaatgtttactcttcatttactcacacggaagcaccaggaagagcagcaaaaggcaagaaggaaggggagggcatgattctaatcagcacagtccagagaaagccttgctgagaaagtgatatttgcagaaacctgaaggcaatgagggactgagtctgggctgaggagtggcaggtgcaaaggtcctgaggcagaagcgtgcttggtgtgttcgaggaacaacaaggaggaggtcaatgtgactggagcagaggaagcttagagagagagcgcacagtaggagttgtagttggggcgagtgagcatccggatcactgaggaccttgtaggacagagggaggactttgatttttactctgagtgaggcgggcagtcactggaagacaaagagcaacgaatatgatgatttcactgactgttttaaaagaagtcctggccaggcaggcatggtggctcatgcctgttatcccaacactttgggaggccaaggaaggaggatcacttgagcccagcagttcaagaccagcccgggcaacgtggtgaagccccacctgtacaaaaaatacaaaaattagctgagtgtggtagtgtacacctgtaattccagctactcaggaggtggaggtgggaggatcacctgaacctggggaggtcgaggctgcagtgagccgtgatcacactactgcactccagcctgggtacagagtgagaccctgtctcaaaagaaaaagcctctggccaccaaacggagaatagaacagcttgggagcctactgcaatagtccaggcagagaaaacagtgattagagtgaatttaagtcaaggtcctgtgtttactgactccgcctttatttttctccctgccccattcttccttctgctgctttccctaggaggccctgccatcacagactctaataatatctataattttaagaaactagccataggaaggcatctcactagttatacatcaaaatcacccaagttgagggccgcagggatttgtctgggaggggtacagggttcccctgctcccagctgaagcaggcctccaacagataggagccacctaagcctcaggaatggcaaaaaaaaaaaaaaaaaaaaaaaaaaaaaatcatgttttgaatcctgaaactccctggcaccttgctaagtccccatagatagtgtttgctctgacttagacctttagaagagcaaattcattcagcatttcctatgacactggcaacgtcgtcatctgtggcaggtcagcaaaatattgattttatcaacgatggacttactggatggtgcatccaaaaatatatatatataactcacaccttaattctctaactcgacgtagttaacttggattgagattaaagggttttttcttaaatcacgttaaatacaaatatcaaacaaatcatagcacagtggtacacaggcccccaaaaagccaccgtgaatggggaggcagttcaggagtgtcatgggagaaactgcattctagcagttgggtggtttgggcccccaagtttaaatcccaacagatgggcctgggggtgaggcctctccagcccatcagagtcacagaggtgtcagagtgacctcaccctcaacccagtatggtgggaaggtttggtcatggaaagaaaccgggtctgtttttgtctgcatgtccccaggtttatgttggacgaaagaagttgaggttggctggcccagctgcattgaaaagcttgaaaactggccttttcatttctgtgtggccgtgtcgttcaggtccttccctcccgtcggagctgtccttctgcattagggctggggctgggcaaggggatgagatcatatgtttttgtgttacagaggtaggtttacacagcctcgtcgctatggcagttttaataaagcaggttactgtccccaaggggaggcttagcacatagcactgcccatgcacagatgctgctgtcattccggggcactgttgtcctttactcgtggattgacacagcgctcctccgccagctgatttgggaagggtgagtgctggccaagagcacctcacagctcgcttcctctggaatgaggaggaaggagatctaagcatttcgagaccctggatctgagcccattaaaaacaagaaatggttctggaggctgttcactgtttgccaaggcagcactgggggctgcggagtgcaggtgatttcatcaggtgacggcctgccctgcgttcccttccaggagaagggtctgaccagttaggtgggtggccagcttttgtcctttctgcagggtctggagaccgagagaggctgagctctcactaccagctgcttcgtcctttctccttcgtgtttgggactagggagcaaaggatcgattccacttggggtgccctggactcgtgcatttaagaaatatttatgagcacccactgcgtgccaggcactgttctaggctgagctgtggagccatcaaaagtcacagggaacagcaaacgggatcagtagataaaaacataaaagtatatcatgtgttagatgatgagtgcagggttgaaaatgtcaggcaaggaagggagtagaaaatattgggggccagggaagactccacggagaagggaacttttgagtaaagacaagaagggggtgagggcaccgctgcggggctccgggggagaggtcttccaggcagaaggaacagcagggcacaggttctgggatgggagcacgcctggtcagtctgtggacagagcaggggaccctgtggctgcagagagtgggcggagagggggatggggttagggaggggaggggattgggtcccaccacactctgtggatggccagaaagatttgggctcctctgagtgagcaggagccccggagagtgtcaggagaggagactctggctacaccgtggggaataagtgactggagtccaatcaggaagcaactggcctgatttcagggagagaggatgatcgcctgacccacgggggaggtggcaagggtacgatcgtgggtgtttacgttgaagagagggcaacaggctttgctgatggattggatgtgggaactgaaagatgggaggaaccgtagccaagatgattgcccaagtacccggaggaaaggggagtggcttcgggaggagcaggagggacggtgacatcagggcttggctgtgggtgtggcacctgaggtctaatcgacagccgaatgacatcaatggatgtcagggttgtaccaagccacacatcaagggatgtcaggtccgggttttaccaagccaatgattgccaaattctaatcattccctcacaattttcatcatatatctgtgtgccacttgtacgattatttactttttaaaaatcggctgcaattgtttgttgttgttgttgttttaagaggatttccaccaccctaaaggaaaagctaaggttacttgccctaagtagaaggaaaccaagccacgcaattaatctaaggcaatgccaccccctgcctggagctcccagtggcctttcacaccaccagcatccctggtgtttggtgatgtgaccctgggccacccccacccctggtgtgcctgatgaagtcaccactagaggacccccttctgggtcaccaagggaccattctgagcttaactgaagccaagagtggaccaagagcatggggacctctatgcacttcctcaggacactgttaccacctcccgtgtgactgtgacattttgtgaacgtgaaactcagcaccccgcctctgctaggcttgagtcttcactgccttcccagctgtgcagccttagccagtcattcagctccccaggttcagttccctcttctgtcaaatgggccattgggagaattaagtgatgaatgtcttcagcccagccataagcattcagccagtgatagtcgccactattaattataatgattattactggcatagaagactgccctcttccccaggaataagttggagtgctctcagttccttagctatatcagaaggttgcaacacccaagccttcaggggtcgggcaggtaatgagagtgggtgcaggtggtgtaagactgtagggagcacgggggagtgtggcaaactggagagcacatatcctgtgtgatgctatttaatgtcacatttttaaaacccactctacaagacaccaacacacaggtctgtggacaccaactggtttggattcctgagatatgaaaacccgagtgtaagatagtattttatatgttaatttagctggtctctgttgagcacattatgtgccaggcactgtgctaggcagtgaacaaagtaggctgagtctctgcccttgtggtgaaggcagcaacatacaaataagtgaaatcaaaatgacttatgtttgaggacagtaactgctgtggagagacacggagcggggaagcagagtggagagtgctatgggttgcgggaggtggtttcaatacaggccagggaaggcctctccaagaaggtggtgtctgatcaataacttgaaggagacagaggtagccctgtgattggaggagtgagagcatcccaggctgggggtacggctgaggcaggggccaggaggtgggagggcggccaatgtgcaatactgggacctcaggggcacgaccttggtgccttgattggtggtaaaaatttaaagtagaagcagctgattgctgagcagagggccttccccagatcccaggaggctgcagtgggtctgatgcttgttttcaggtttctagggggttgctaggtgattgggatcacagccttcacatgcctggtagaccctgttttggtttcccactgctgtcctaacagatcacaaactgggtggcttaaaacaacagaaatttactctctcaacagttctggaggccggaagtccaaaatcaaggtgttagcatggctgtgcttcctcagaaggctctaggggagagcccttccttgcctcttccagccctggggaccctaggagttccttgttccttggcttgtatgtgcatccctccagtctctgcttccctttgaatgtggccttcccctctgtgcctgtgcgtcttctccactttgtgtcctatgtggacacttgtcactggatttagggcccacctggggaatccagaacaaatctcatttcagtagcctcaatttaattacatctgcaaagacaccctgtattggtctgtcttcatgctgctgataaagatatacccgagactgggtaatttagaaagaaaaagaggtttaatggacttagttccatgtggctggggaggcctcaggatcatggcagaaggtgaaaggcacatcttacatggcggtaggcaagagagaatgagaaccaagcaagagggaaaacctttataaaaccatcaaatctcgtgagacttattcactaccaagagaacagtatgggggaaacaacccccatgattcaactgtctcccatcagatccctctcacaacacgtgggaaatatgggagccacaattcaagatgagatttgggtggggacacagccaaaccatatcaccctctttccaaatatggtcacattcacagcttccagaaattaggacatggtcttatctttaggggacgggggcaccgttcaacccactgcacaccttaagaactgcaaggaaaaggggaaaaaccaaggatggccatagaagaaggagagagggtttccatggaatatttccatcaaatcactaagggtctgggtaccaaccacagcatacaattgagcatgcactcgtcacacctatgttgagtacccactgtgtgtcacacacggcagcagtgctgaggattcagcgctgagcggagcacacagcctttgccctcctgggaccttggcctgcacgcagtagggctcccacacacgttcatttgcttccttccttccttcttgcctttcttcctaagtgtcttgctctgcttacagcttggttgagaaacaagagcaggcatggccaggcaaggtggttcatgactgtaatgacagcactttgggaggcagaggcaggcggatcacttgaggtcagaaattccagaccagcctggccaacatggcgaaacgtcatctctactaaaaatacagaaactagctgcgtataggggctacttgggaggctgaggcaggggaatcgcttgaacccgggaagcagagattgcagtgagtcaagatcacaccactgcactccagcctgggcaacagagcaagactctgtctcaaaaaaaaaaaaaaaaaaaaaaaaacaaagaaaagaaagaaacaagagcaggcatgaccgaaacctcgaagcctggggtatgatcagtactcaggacacatgctgcaagactgctcagagctctcaagcccagggtggtgccagaggctccctacgagagggtactaggccgatgggttggatttggggtgaggggtggtgggttccaggctcgaagaaaagtgtggacaagaggccagcagggtttgtggctgatggcagagcacctcagccagggaatactcagggagaaggtttgccaccaggttggcatgaccagatttcagtaagagcaaacaattattgggaaagttccaaagaaaagaaagtataatcttccctcaatttacatggtggttggtttccaaaagaaaaaacaaaacaatgtatattaataccctgcaaaaacaatgttgtgtttaaaatttgtaaaacagtttgattccagtctcaggtcatttataaacaggtttttacctgccttgcaggtagagatgcaattacagtaccggacagtgacagtacagtcacttacagtcactcacctccagcaccattgcaaaatcctccagactccagacctggacctcaggagtgtccaggtggactcgggacccagggtccttcctgattatgcaggacagtcccaccgtgcagcagtggcccctgccccgtctgccccgtaggtctgcagaatgtgcccactccagacctagggatgccacgtgctgagagccccctggtgccggtgccgcccgggtctcctgccctgcgccttacttccacccttgacttgcaggttccatgcaggtgatgaacaagacccggcgcatcatggagcagggcggggcgcacttcatcaacgccttcgtgaccacacccatgtgctgcccctcacgctcctccatcctcactggcaagtacgtccacaaccacaacacctacaccaacaatgagaactgctcctcgccctcctggcaggcacagcacgagagccgcacctttgccgtgtacctcaatagcactggctaccggacaggtgagcagggacgggggcaggtgcaggaagggagtgacagccagggcgggcgtccctaggtgtggtctgcacaccactgcggtacccaagttgattctggatagcccctagagcaactctcttataatttcagagttgtgcatttatttctgtgtgtattaaagaaatacagatttatttgcctacagtagtgatgtaaagtgaccttgtcaaaggaatttgagtcccccaaaaaagtgagtcttttcaaactatgaatcatagtgtggagaggccataaggtgcccatgcatgagtttgcatcctctgttaatagttattaagcccatcagggactgtttcgttgacttcaaaccattagcttggaagaaggttccaaaacataggggtgggggatgggaattcatggaggggaacagataatggggctgtgtggtcgctttctacgtggcagtaaccaaggtggtgcagaaactgacatggtggttgactgtccacactcacccgtgtcatcctgggtggagggcgacccagttcctgtttgcttatccttcaggaggtctttggtgggctctgaaggctcacctgccaggctggttgtctgaggtagagatgcaattacagtatagtcacttacctgtagcgccattgcaaaaccctccagactcaattcatttaacttgctttaattaaaaataaataaatactccccgccttgggtaagaagccgcggcggttgtgaaatcaagatattgtggctcagatgttgcaaccccaggaagttgcatccaagtgacaaggggtttgtttgggtgggagtgccgcaagggaaggatggactcctcctccagccctgtccgcagtgctggacctgcagccctcgaggctgggcagcttcctctcagatacacagtgtgggctggcagggatgctttggtgtggggagcaagccagtaaggtgtgtcttcttacagcctcatcccatagccagaatcacctagaaagtatgttctgctgagaactaggaaggcctcgttcctataccttgttcctgtgtattgtgcgtgccattatgcagaatcaaccacctgttggttcccctgagcctctgcagaaagccacatgtgtcagaagttaccatggccaccaccctagatgattggcgggggcctggatgttgctagcagaagcaggacaggcaggcccgcagcacagcagtgggcccttattgaagatgcacctgcaacttggctctagaaagtacagccatgcactcaagagtgaccagccttgaaatgttttaaagtctgaatatttcactgaaaatcttattttaaaatatgccggcacagcttattttttctttaatgtatactgggggccaaagaaaatatgtctgaggagtgagtgtgtggctcacagactctcttttcacaacctctgggtgaaaggtctgtacagaaacctttcgttttggatgctggaagatcagtaaagaccctagacctgttctcatcaatccccctcatttcacagccagggccactgcagcccaaaaaagagacctgcccagagtcaaagtgaggtgtttgtggcataatcaaaatggaatgcaagatcatgggaattcagagggggcatggaaatagtattcatcagactgaaaggaaactcatatattctgtgccattttgagggctcagggtgggagctaaaggctagtgtttcaaaatcttacaggcgacatgagaaaatcaatcatttcaagaataaacattctctaaagtggatttcccaaacttgtccttgaatgtatgcaaatcaccaaaaagctgtctccctaaataagtgcttttattcaactatgattcattattataccctcatgaagactgggagcgtaatgtcaagtgtaaagagccagataccgagaacatttacgtttttgtaaaactgccactgagaattttattcattatatttagaatgccactctgtacaaagaatcccattccagccttactttcagaactcaggaccctgaaaacacctgtttagtctgatgaactggtgtactccttgttattacataataagagccacataccctgtatagtttccctctttgccctggcagctaggaagctcaggtttgagttttatattgagttgttgtttaaagtggaaatgtttttaaagatccaactgcgtgatatgttatactgatcagtgttgactaagaaaaatgacaaaaatctataatgaattcaaaaccttttagattattttttccttttagattgatttgtacatacatattagaatatactgtaaatttttaatcccccaaggaccaaaagtaaattgttcctgctgagtcttcagccatgttaaaccctgtgttcacgtggccacctagcaaagttggttcagttggatttaagtttggctgtgtgtgtgagagagaccggggatgtcaaataaaattccaagttgttctggtggccctgctctatgaagtggtcagagactccgactccatttctccttatttcccattggtgagaaacaagtcatatggccatgcatggcagcaaaggggcctgggaaatgtagtcttattctaggtggacatttgcccagatgaaagttattttactgtgggagaagaagaaaacggatactgaaggacaagtgaagtctaggccaccctaacagttattagccatttgtgtttgtgatactcgtttgaatagaggagatcagcccaaactgaggaagactgaccccagaaaaatgctacttaagtggaccaacatttcataataaatagtgcttttaatgtatttagtaaggtatttgatcttgaaatgaaactacaatgtttcgagaataactctgttatgttacatctctttttttctttttctgagacagagtcttgctctgtcacccagactggagtgcagtggcacagtctcagctcactacaacctctgcctcctgggttcaagcgattctcctgtctcagcctcctgaatagctgagattacagacgcctgccactacgcctgactaatttttgtattttttgtagagatggggttttgccatgttggccaagctggtctcaaactcctggcctcaagtgatccacctgccttggccttccaaagtgctgggattacatgcatgagccaacgcacccggccctctgttaggttgcatctaatgatatttaacaaatattgggctctagttgcaactaatgagttgattcttcaagcaagtgaattgacgaagtgtagggaggaatataatgtgtttcacaaattgaaatggatggcacaagatgatatcctttacttcactagggacatttttgcaaaagtatttgaggatttgatcaattttttcaagggcctctcctaattctctgacatctgaatcttcccctgtgaagtgcatctcatacttcatcatccttctcaatagtctcttctccttcatgtagtatctttatagaccaggtaattattcgtcagtggatttgcatgtgttttttgagctatcttccagcgtcattttaattaattttacaaaccctgcatcttttaaaatatttgcaatttcattttgcagtgatcttgctttgcatggccccatgtttgcagtggagattgacaaaagacaaaatgagagaagctaagtttaagcaggataaatatcaatttgttcatgaatatttctctgtatggcttcttacaacttgagggacttggatctcagatatgaatacccttggaaggatcaattgcatcctcaggttttttgttttctttgtttttttgtttgtttttgagacagggtctcactctgttgcccacgctggagtgcagtggcgtaatctcagctcactgcaacctccacctcccgggttcaagcgattctcctgcctcagcctccccactaactaggattacaggtgcgtgccaccacgcccagctaattttttgtatttttaatagagacggggtttcaccatgttggccaggctgacctcgaactcctgacctcaagcgatccaccctcctcggcctcccaaagggctaggattacaggtgtgagccactgcacctcgccacatcctcagtttttacaaaggttttatagtcatcctttaacacagttcagcagttgaagtgctgttgccctgcctgtgatcacttatatatccacaagtcaaagttgtacagtgttcccagaatgagacacctcccagctctctgcagagtggttgagggcattagctttgcctgggtttgaatccagtctctgctgctttctgcctgcatgaacttggacaagttatttagcttctgtgtcttggcctcctcaaccacagttaataatgtcacttaactcatagagttttgtgaagattaaatacattagaacagtgtctggtacatggtcgtggtaggcacttgggaaatttagcaatgatggctgggtgcagtggctcacacctgtaattccaacattttggggggccaaagtggaaggatcacctgaggccaggggttcgagaccagcttgggcaaaatagtgagatcccttctcaatttttaaaaaacagtaataaaaaaaagttagcaatgacgatgacgatttgcacaatagcacaacatcacacagcccacctcaggccagtgttctgatgaatgtcatggtaagttgcactcatggatcaaaatgtggcagcatgtgctcagcctctggtaatcagcaaaatgcaaacgcagccaacagtgcattatcacatcccagccatgaccacagcaaatatgaagaggtcccatcgcaccaaatgttggtgagaatgtaggaaaacaggaaatcatatgcgccagcagcatgatggtaaattgttccctccactttgaagaacagtttgccaatttctggcaaagctgaaaatggacatctccttctactcagcaattttactctggctgtgtccccctcggttctgaggaggtgatgttgatgtgtgagttctgcttgagcaagggaacacacttcctggctgccctgtttgctcttgaagatgtgtgatgctcatggcaatagattccctttagatccaacggacaggaaccccgactgcagctggcttcaaaaacattgaattttttgctccctaaacaggccaggcacggtgactgaagcctgtgatcccagcactttgggaggcagggatgggcggatcacctgaggtcaggagttcaagaccagcctgaccaacatggtgaaaccccgtctctactaaaaatacaaaaattagccaggcatggtgatgtacacctgtaatcccagctacaggggaggctgagacaggagaattgcttgaacctgggaggcggaggttgcagtgagccgagatcgcaccactgcactctagcctgggtgacagagtaagactctgtctcaaaaaaaaaaaaaaaaaaaaaaagagaagatacaggtgagtagcaggcagagtcggatcttgtggtttacgagtatcatgatcatatcacgaggctggaggtctggacatggtggctggcactccagcagctgtgtgcctccttgtccacatctggcaggagcaagagagcatccttttccagaatgctcaaggcatgagatcccttctgattggaccaccctgagtcacatgccagcccctgagccaatcatcatataaagcacatggtttgtgccaacttgcccagcgtggatcacctgctctgcagcagctggctgagtccctttttccccagcacttggactgccaggtagaaatcaagggctgctggaaagaataaggaaaagcatactggagtgccgatcacaattttactacactgcctttggcaaacaaaaaacaaaaaaaaagtaacatcagctggccgggcacagtggctcacgcctgtaatcccagcactctgggaagccgaggagggtggatcacaaggtcaggagtttgagactagcctggccaacatagtgaaacccgtctctactaaaaatacaaaaattagctgagtgtggtggtgggcgcctgtaatcccagctactagggaggctgaggtatgagaatcacttgaacccaggaggcggaggttgcagtgagccgagattgcaccactgcactccagcctggtgacagaatgagactccatctcaaaaaaaaagtaacaacaacaaaaaggcaaccttttccagctctttctggtgaactagattggagtgccattttctccccattgggataatgcctttctccttccacacctgaatctggcagttctgaagttgtttcccagccccagcttctgccatccggtccagactttcgcagagatggtggcgggccctctgcccttctgcatcatgttctaaaatgcgtcaggggagcagggggtacatgctccttacaagaccaggccttgccagggctctcagttggagcctgttttggggtttggccctgagcgccccagttattttcactcttctcgcacaaagctgggtagagaggtcagctgaggaccagaacctggccatcagccttgggcagctaccctcaccagggtctggggggcctctgtgtcctgatgaccccaccccatctacactacactacacttggggcaccccatcgccctctcacacaggaggatggaaaggcgcccgctaggcattttggcatccccaacaaatgagacttgttttttccctaaagcggtttcattcaggaccgcaggggcaggagggctgctgcgtgggccgtcctcctctgcaatgctataaagtggcccaatgcccctctttccctgccactctctggatctacccttagccccttgccctgaaccccatccaccctggcccctctgcctcctggccatcgccccagagctctccccagcacatcaagcatgagtccagcatcacttcctggtcccccgcctccccggcgcctctcacaggcttctcctcggcacctccagttttccagttgctcaggccaaaaccttagcaccattcttgattttttttttcctattcctttcacactccacattcagttcatcagcaaaccctgtcagctctgccttcaaaatatgcccagagtcccctctgctgccaccagcccatccgcgccactgtcttccccgcctgccctgttccaggtttctcctgggatcccccagcttctgcgtttatgaccccttggtctgttttcaatgcagcagccagaggggtctggtcagaacctagttcagatgctctttctcctctgggcagagccctccttggctcccacctactcagggtagaggccccgacagccacctcagggtcccagtgatccttcccttctctctgaaccctctcagcctcctggtctcccctcagtcactgtcctccagccacagcttctcaagcagtcagccacacctgacatgcacccactcacagtgctttgcacttctttccttttctcaaaacttctacacgtctgcactttcctcgtgtctgtgttccaatgctgcctcctcaaagaagccttccttgactaccccatgcctcctgttcatcccagttttttcccaccagtgcccccatcaccactgaacaccactgactgtgtattctgcccatttgtctcattgattgtctcgtttctaaaatgccagctctcaggctgggcgtggtggctcacgccagtaattctaacactttgggaggctgaggcgggtggatcacttgaggtcaggagtttgagactagcctagccaacatggtgaaaccccatctctactaaaaatacaaaaattagctggatgtggtggcgcaagcctgtaatctcagctactcgggaggctgaggcaggagaaccactggaaccagggaggtggaggttgcagtgagccgagatcacaccactacactctgtcgcttgggtgacagaatgagactctatctcaaaaataaataaataaaatgccagctccctggaagcagcggcctctgttctgtgccctcgcgggttgccaggcctagagagtgcccaccccatcgtaggtgctcaggagaccttcccaggatgactggtgactaagtctccacattctgtccccgccagcagcccacccccatctcttccacactcctttctcctctcccgtttctctcctctccacccccactcccaccatctcagcctttcctcctctttcttctcagcctctctgcacacacagggaagagaagactgaaattattcccgggatgccgtccctgggcccctggtgcagctgtccctgccttcacaatggcagccttctctttgcttggctcttctcctgggtttgctccctgctctcttcctctctccttgagtgcacacaagtgtgcacgcacgcacgcacacacacagctcccttcttccctcggtccagctgcctctcatctgcccatcttccctccccctctccggcctgtggggggacagcagagcctctccattcaccccgtggagtgtatccactgctcacagcaggtagccttcctgtctctctgcagcgaacacccagccttccccactgtggggatccgagtatccacgggaattgcacagcccctcctgggacccaggctgacccagcgtgtcctcgagaggcacggatttgccgcctccgtgcacatcttcaagcgaaatttcttcctctaatttgatagtcacttcctttctctaagacctcagatttcaaaataagtgaagcacttgttttgagcaagagtctaaagaattagactccgccttaagcgcccttgtgaccttgagctgagacctcatcccctctgggcgtcagtctctccatctgtgcagcagtgttgtgacatctaagcactagtcacccagtgcctgtgataagacgccaccctgagtgatacgtgacctgtgcccacaaacccaggaggagaggttccctgcgccgtaagaggaagtggccacggggaaagaggaagctgatgtgaggccgatggggcagggtttccgattgtttccaggcgacaccctctctgtcccacccccttagcaggtgtatccacttccctagtggaccacagactgggtggcttagaacaaaaggcgattttcacagttccgggagccagaaccccaaaatcaagcatcatcagggccacgctttccctgcaggcttcaggggagggtcctttgcccttgagttcctgggggttgctgggaatcttggcaccccttggcttgtggccacatcactccagcctctgccttcatcttcatgcggcctcctccctgtgggtccctctcttcccgtggcctgctcctctctgaatcagtgtccaaatttccctcttctgtcaggacaccagtgattggactagagcccgctctgatccagcgtaacttcatcttacaacaccatgttacaaacacggtcaccctcacaggtacctgggcaaggacttgagcatatattttggggaacacattcatctcgtgacggctggtttctttcacacattaaaccccgcccccccccataaaggctgcagagccgatgtcaaactgagcaaacctgccgctcttcccctcttcactgccccagctgtggtcctgggtggggagcagtgtggccgccctgaagatcagctccatgcgtagccttcccttcccaaccatggtttctctcaaggaatctccacctgcagtgggcgttgaaacagctgcagggtcaaaagtgagggaagggtgactgtggtgacagacaggcacaccctgtctcctgggcctcaagaggcttccgggggtttcagagtgcatgagaccttttgtagtcctctcctaggtgctagctgtgactccctgaacattctggaatgagttaggctggagccaaatggcccagtaccgttgccactagccacagggagctatttaactttacgttaattacaattagcatttcagtttctcaggtgcactagccatggttcaggtattcagtaggcgcacatgggttctgtactggataatgcacatagagaatgtttccattggcacagaaaggactcttggacagcaggagaatagagcctatggctgggcctgtaatcccggcacttggaaaggtcgaggcaggaggatctcttgaggccaggagtttgagaccagcctgggcaacatagtaagacctgtatctttacaaaaaatttgaaaaaaaaaaaattagctggacatggtagtccatgcttgtagtcccagctacttgggaggctgaggcaggaggatcacttgagcctaggagtttgaggctgcagtaagccatgatcacaccactgtacttcggcctgggcaacagagtgagaccttgtctctaaaaaagaaagaagaataaagcctaatcaaacaaaatcttttgggagtggggagtgacacacagcactgagaaggggcaataaaaacgcagggggtggtggctgtcgaactttaggtgagtgctttccgtgattcctcatctgtaatccaatctcctcctcctcatccctgcactcacttccccttatgctcccagtaccttgatctgtcttcccaaaccttcctgggtctcgggtcagggtctcaggacaggttcctgttctccgagcagcagacaccatccatcccggggccagcaggttgtgccagcccacacagcgagtcctttgggaatccatccgtgtcgcaggggatttgagcaaatgaagggaaaccgagttcctacaccgaggccgggagcggggcttcctctgtcatccctgtgtgaacccgttctagcctgggggctccaaatgcatagagggctggcaggtagcccaaagcagagaggcaggctgggtggggagggggtgcccagatttcaactgtggactgttcactctactttttaagaatgagcaactgaaaacaccgggcaggcccacagcaaacacacctgagggatggattggtctgcaggccaccggcttgcaaacttctttctaagctggtggttctcaagggagcacaccgccccctaggggttaaactctgtgactgcattgccggtgatggtgaaggatttgactttgctggcttcctgggggcggagactaagaaggactttgatgtcctgctctgcacagcagagtccacgtggcccccacattgcattgtattccacatagcttctgagtttcctaccacatcactcatatgggtagattattttatgtttattgtcatctgagtcttgaacctacgtctattttatatgtaaatactggagggtttttgcatattcccaggaatgtacggaataagaaaatggaggcaatattatacttgagtgcaaaactttcccaagagtcattccttatttctgaaagtcccatccccgatgacagtgctacgccaaaggatttgaatggcaaatgtcgcccgcccacccagctgcccttgtaattgtcacattcccagtgaatctgtgtctaggtgcaggcgtctgcctgactactgtgttgtgccttcttgatggatgtgctgggggaatttcatattgaaatttatcttcattataaattgctttccttttattttccctgtagattgcagttagagcattatattgattttgtggaaatgacatgcataggtagcttttgttacctataaatttcctttcaagaaaacaagggcgctctacaaaatatttgtcatagaaatgggaggtcagtctgatggcgctgagaacagctctttgaaaggtgcaagtagtgtcagattcctccaaggcgataattaaatatccattgagtgacaggccttgttctgagggtctgttgtggattttctccccctcctctagtccatccctctgaacaaaaccacactttaaaaggcacaagacagatatttaagacacagcttgtcctcgtggtgactcagcaggcaataaaacctgtcactagagatggagccctccatacccagctaattgagtttccagggaatgaatgggcctcatcctcatttgcaggagctgcaagacccttctagggagcggatggctggagccagcatttaattaggcacaggcagcccgccctccatgccaccaacacccagagctccgcctggccctgctacaaccagtcagcagggccttggtgtcccccgcagcccagtcttcctcaatagccacagcctcactaaaaacaggcaggcggaagacaggaatgcatggagtggcaagacagaagcagctctcgcctctcgccctggcgatctgcttgtccctgtttgtccccagcaactggccattccttctccccacccacagccggaggacacttttaaaaattgtaaacctgaccacatcacttccggctgaaaacctcctacggctgcccactgctttttggataaactggcatctcctcgccagggctgccaagaccttgtttggcctgggtgtgctcacctctctgtccacatctcctatctgtcccttccttggtgacagcactcaggctgcctagcctctttgttcctcagaacttccaaggtccattcctgccccaggccctttgtatgtgcagttacctctgtctggagcactggcccacaaccattctggtacaagcaaccggtttcgtggaagacagtttttccacggactgggggtgagggatgttttgggatgattcaagcgcatttcatttagtgtgcactttatttctaatattatcacattataatatgtaatgaaataattatacatctcactataatgtagaatcagtgggagcccgagcttgttttcctgcaaccagatggtctcacccgggggcaatgggagacagtgacagatcatcaggcattagattgtcataaggagtgcacaacctagatcccccgcatgcacagttcacaacggggttcacgctcctatgataatctgctgctgatctgataggaggcagagctcaggcagtgatgcaagtgatgggaagcggctgtaaatacagatgaagtttgctcactcgcctgccactcacctcctgctatgcagcccagttcctaacaggccacagaccgctacctgtctacctgtctgcagcccaggggttggggatccctggtctagagcgttgttcacacactgcggagaacttcctccatccattctctcttccttcctgcccttcctgtgtcggttagtactcctcaaccctctcattctcgaccatgacacccggctttatgttcttcttaggacttctcgcccccttgaaattatcttgcatgtttgtgaacttttttttttttcttttttttgagatggactgtcactctgccacccaggctggagtacagtggcatgatcttgactcactgcaacctccaactcccaggttcaagcaattcccctgcctctgcttcccaagtagctggaactacaggcacccaccactacactcagctaattttcgttttttgttttggtttttttttgagacggagtcttgctctgtcgcccagcctggagtgctgtgccacgatcttggttcactgcagcctccacctcccaggttcaagcgattctcctgcctcagcctcccaagtagctggcattacagttgcatgccaccacaaccggctaattttttacatttttggtagagatggggtttcaccatgttggccaggctggtcttgaactcctgacctcaagtgatccacctgcctcagcctcccaaagtgctgggattacaggcatgagccaccgcacccagccaatttttgtactttagtagagacagggtttcaccatattggccaggctggtctcgaactcctgacctcaagtgatctgcctgcctcggcctcccaaagtgctgggattacaggcgtgagccactgcacctggcgagtgaacttgttttttacatgttttgtttgctgcccatccaaaaatagcaccaggcaggtattgggtactcagtaaagatttgaacaaggccaggcacggtggctcacacgtgtaatcccagcacttcgggaggctgtggtgggaggatcacttgagcccaggagttcaaaaccagcctgggcaacatagagagaccctgtctctacaaataattttaaaaactggccaggcatagtggcacacacctgtggtcccagctctttgagaggctaagatgggaggatcacttaagcccaggcctttaaggccgcagggagccatgatcgtgccactgcattacaacctgggcaagtgaaacctcaactcaaacgaataaaaaaaatgaacagatggagaactcttgggccttaggcttgaagtcagcaaaaaaataaaaacaaaatggaatttagattactatctcatttatccagcatgaagaaacataatcgaaattagttcaggcaaactttgccaggtcccagtgctcaaacgctgtcagaaccctgtctttctgcttcttgcgttttctgtcattgggttggctttattaggaaggttccctctttgtgatggcaagatggcccccacaggtccatctccccagtgtggtgaccccagctgaaagagaggcctctttccaagggctccagcaaaagttccagggaaagctctcattggctcatctagggtcttatgtctctttcacccaatcacagcagccaggcaaaaggagataccctgattgtccaggccaacctcatgggcctggtccaggattcagagctagaaagagcctcatcagaacatgtaaggctgagaaaggggaaagattggttccctccctctttggtgactgaaggcacaattatgaaaagacaggagaatggattctgggcagaaaaataaaacagatatccactatagaaacccacatgcaggccgggcgcagtagctcacgcctgtaatcccagcactttgggaggctgaggcgggtggatcagttgaggtcaggagttcgagaccagcctgaccaacgtggtgaaaccccgtctctactaaaaaaatacaaaattagccaggcgtggtagcgcatgcctgtagtcccaggtactggggaggttgaggtaggagaatctcttgaacccgggaggcagaggttgcagtgagccaagataatgccactgcactgcagtctgggtaacgagtgaaattctgtctcataaaaaaaaaaaaaaatagcttcttcttaaagggcaagtgggaggagagcatttctcccagcccccagctcgctctgcttccaacataagatgcctctttcgtgcggaatcatgaccccaccttcctcatttgttttcacacagctttcagttcagcaagatcccatctctggcatccagaacttttatagcattgatttatcacttcgtgcagtgatttgcatttggtattttttttttcaaaagcagaagaactcgactcaggctgtaaccttgcaaagcagcacaaagttaaaaggatccagttacagaatatcagaaataccccagccctgagagctgtggagctctgggtttatttaatgcatttcttgccagccctgcctcctcagccaatttgtctgccaaaaaaacaaagacttcagtcctgtggcatttcacatctaatatttatgctgttctagagtttgcaaaagggcttccttttcatttatcactgttcctcaggaacctccagctcccctgctaggttaatgggattgttctctgctgcccagaccgggagccccaggaagccaaatgacagatcatgaaagtggcccagtggaggactcttctactggtgtcaggggtaggatcaaaactcagcctgaaccagctcagtttctattttgtgaccctgggggccaaatatggatcttgcaaaatggcagctggcagcctgagtctacacttcaaccccaaatttctgtcagagttacaagatgctttttaaaatctggaaatttaaccaaaaatacccagattacaaacttctctttaaaaaaaaaaaaaaaaagattatgataggcctgtaatcccagcactttgggaggccaaggtgggtggatcacttgaggccaggagttcaagaccagcctggccaacatggtgaaaccctgtctctactaaaaatacaaaagaattagccgggcgtggtggtgtgcacctgtactcccaactactcaggaggctaaggtgggagaatcacttgaaccaggaggcagtggttgcagtgagccaagatcatgtcactgcactccagcctgggtggcaaagtgagaccctgtctcaaaaaaaataaaataaaataaaggccaggtgcagtggctcaagcctgtaattccagcactttcagaggccaaagcaggtgaatcatgaggtcaggagatcgagaccatcctggctaacaccgtgaaaccccgtctctaataaaaaatacaagaacaaaattagccggtcgtggtggcaggtgcctgcagtccgagctactcgggaggctgaggtgggagaatggcgtgaacctgggaggtggagcttgcagtgagtgcagtggcactccatcctgggcaacagagcaagactctgtctcaaaaaataaaacaaaaatttgaaaaagataataatgataatgatggtattgccattactggtaacattcctgcatggtggagattagtaaactgtggcctacaggagtctgctgccaggttttacaaagttttctggaacacagccacacccattagtgtatgtactgtctgtagctgctttggctctacggtggcagaattgaatcattgcaatagagaccttatggctgcatagctgaaaacacatagtctggccctttgcagaaatagtttgctgagccctcctaagtggcgccagcccactggatttgtgccacagatacccccaggatttattagaatataggtggagttgagggtacttcagtccctaattaacagcggattagagatgataggtgcttatttctctcccatttgacagtttgggcataaacagcctagagatgatgtggcaggcatggtgttggctcccaggctcctgatgggtgatggtcagatggcgttccatcatcctgggcgatcgtccttatctaaagcagcatcccatcctgtctgcatccaaccagcaggacacagaaactataagggaagctcacttcccttcctggaggggagtttccagaagtcacacaccacctggtgtacccctccagttcatagaaaatacagagaattacaaaggaagccagttatatgaaaacatatttatcaaaatattttataaactgtgatatgtatgcttctttacacataaaatggcacgatgaagcagttatttaatggacaatggataggtctgataacttccatgatttcgaagtagcgctggctcaaatgatattttaagaagtccatgttgactacaatgtgatatgaaaatatccgtaattcccattggtgacaaagtcccagggaccatcattcataattgaaggggatgctagttataggttaatgaaaataaacaaatacatacttttgccattcaatttcaggaaattatatcttgggacaacagattaagaacctcttcctcaggtgatctgattcgattccatggcattaagtgccatctaaatgcttacagctcctcagtttgtaattccgtagcttttctgtgaacctggtctgtttccacctgaatgtctaacctgagtctcgaggttaatgtgtctgatttctttatcaacccccatccccaactctgcccctcccagtgtccctttcctaaataagggcaaatctgtcctcctcattgcttggaccaaaaaccttgagttatccttgactctctttacttctttcgcatgccacatcagcaaatcccattggttccacctttaaaaatagcctggaaccaaccacccaagcccttcgcctgccacgattgtggtcatcacagtctgtctcctgaatgactgtgagagtctccaaacattccagttccctgcctcggactggccttaattctaggacagaagctccaggaagatgcaggttttttgctgctttaattttttctgttttgttcactggtatccccagtgcctagagccatcccagccacacaggagtcctcctttaatgtttactgattgaatgaatgaatatataacatcatgatcaataatattatgataaaaacagtaaccatttagaggcagttaacatattttctcattgaatctttcccagcaactttgtcatgtagggatattattattattcctattttgcagttgagaaaactgagctggaaggcagaggtagctgaacttaaatgcaagctgttggctccagagcccatgcccagccctcagacctgcctgcctcggaggataaaaatcatttctgaggccaggccaggtggctcacgcctgtaatcctagcactttgggaggccgaggcaggtggatcacgaggtcaggagatcaagaccatcctaaccaacaaggtgaaatcccatctctactaaaaatacaaaaaattagctgggcatggtggtggcgcatgcctgtaatcccagctactcgggaggctgaggcaggagaatcgcttgaacctggcaggcggaggtttgcagtgagccgagatcgcagcactgaactccagcctgggtgacagagcgagactccatctcaaaaaaaaaaaaaaaaaattatctctgaaaccctacacttctggaaagactgatctggataacgactatggctcctacctgtgtcccccacctatgcttcaagaaaggcaaagtgcccgggtcctgggaatgaccttccttcaaaagcccacggccggatgaattctgggaggatgcagcatgggaagataacctcagtgtggaaattccctttgcctggaattctggcagaaagcacttcggagatagtctgagccacatcggagaggaggagctctcggaggctgagtcccatttgtgtgtgtccccacctttagccatggggcagtccctctgctgttccctcttccctgcctctctgcgtccccgtggatgggaagagctccagtctgtggtcgctggagtcctgctgagaggctgaacagggtagtcaccaaaaggcaggtggagacagacaacctgggattgagcctcatttcagctctgacacttggcagttgtgggatgttcggtgaaaaggggactttgcctctctgtgcctcagtttctccatctgtaaaatagggaccaaaaaaaggatctacctcactgggatgttgtaggtcatcgtctaaaccagtggctctcaaagcgtggtcccaggatctctagactcaaaactattttcatgataataccaggacactgtttacctttttaccgtcattttccttctggtagacagtggagttttctagcaggtacatagcatatctagttatctaaaaaggattaaaatactcttcccttttccatctgcatacccattttattttattttttagaaatagggtctcgcttgtcacccaggctgaagtgcagtggcacaatcacagctcattgcagcctcgaactcctgggtccaagtgatcctgccacctcagcctctcgagtagctgggaatacaggcacacaccaccacgactggctatatttatatatatttattttttagtttttgtagagatgaggtctcactttgtcacgcaggctggtctcaaactttttgcttcaagcaatcctcctgccttggcctcccgaagtgctgggattacagacgtgagccactgtccctggcctgcatgtctgtgtgaggctggatttttcatgttaaacaaccaaaacaatatatctcagcagattgaatgccaaaacagatttaagaatcctgctgccttccagtaaacaagacattgaagagattggcaaaaatgtaaaacaatgcaactcttctcattaattgtattttgtttgggaaaaatatagttatttatctttttttctccccaagacagagtcttgctctgtcactcaggctggagtgcagtggtgcaatctcagcttactgcaacctccacctcctgggttcaagcagttctcctgcctcagcctcccaagtagctgggattacaggcgcccgccaccacacccggctaatttttgtatttttagtagagacagggtttcaccacattggccaggctggtcctgaactcctgaccacataagtcatcacgcccagcctctatttatcattttttaaatgtatgctaacaagtagtgagtttattatttaaatgagtgaacaaatatgttttaaatttctcagttttcatctctaatataataactatcactagatataaccaacatacacaggactctgggttccttaataaattttgaccatattgaaaagcactgctgttgccttacactgaccttgagtgcttttttggttttataaagcacatccacaaatggaagtcatgtcccgtgtgggccaaatagatccaagttcagccagccaaacaccatacaagcaaataggaagacaagaatttaacaattctacccactcctccactcacagagggtgtgcaccggatgataaaaaaacaaatctacgttctcagccaggcgcagtggctcacgcctgtaatcccagcactttgggaggccaaggcgggtggatcacttgaggtcagctcaagaccagcctggccaacatggtgaaaccctgtctctactaacaatacaaaaattagccaggcatggtggcgaacacctgtaatcccagccagtcgggaggctgaggcaagagaatcactggaacccgggaggcagaggttgcagtgagccgagatcgtgccattgcgccccagcctgggtgacagtgtgggactccatctcaaaaaaaaaaaaaaaaatcgacattccctcactcagctgtgtctcccacaggcctcccattacgaggtgttcgttggttcagttgtttacccatttattccacaaacgttcatcgaggtctcgtcactgaccaagctctgttctagatgtgaggacacaggggacaagggactcagaaagccgctgccctcatggggctggtactctggtgggagaagcacgtgataaaaactagaagacagataaatatgaccagtgaataaatatgtggagaagcaatgtcgggggaaaggggagagcctgggcggtgtggggagatgccatttgaataggagggttaggattgagccccagtaagttaacatttgaggctggacatggtgactcacacctgtaatcccagaactgagagaggccaaggtgggcagatcgcttgagcccaggcattgagaccagcctgggcaacataatgaaaccctgtctctacaaaaaaaaaaaaaaaaaaatacaaaagttatctgggcatggtggcttgtgcctgtggtcccagctacttggaaggctgaggtgggaggatagcttgagcctggggaggttgagggtacagtgagccacgaccgcaccactgcactccagcctgggtgacagagtgcgaccctgtattggaaaaaaattaaaagctttgagcaaatagctgggaaaggtgaggaagcagcccatgcaggtatctgaggaaggtgatttctttcaggtaacagcaagggcaaaggccctggggcaggtatgagctttggggttggggtgctggtaggatagagggagaccccaggacaggaggctggggggaaagtgggggcagatgcagtcacggagcaggacaggagacagttataggactttgtagggcatggcaaggactttggattttagttgaggtggatgtggagccactgaagggctttgcacagagtggggggcttgatcaaatttgtgatttaatgggatccttctggctgctgtggaagatgggctgaaggtggaggcaggaggaccagggacgaggttccagcaaggtccaggcagaggcagtggtggcttggaccaagatggtgacaggcggatgatgggaagtggtcagacctggatgtgtcctgagggtgaagctgctgggacatatgtgagggaggacagaggagctgaagtcccctccatggtgcgtagccttgacccactggcattgacggatgtatggatcacagggcgaaaatcaagaggccggtgtgaagtgctgatttgacaccaaatgaagtgatttgaaggaaattactaagtatgcagcggtccaaatgatacataaaaacggccaaacgtgtgtgagaggcacgcggacaactggaattgagatgatgccacgaagggcaaagaccccgttttgttttcgcagactccgtgcctgcgaaatggcgcgggtctgttttgggaaggacggactttccacaggcttctgcttcatctttcgccgacctctctgaattgctttggcaaacactgtttattgtcattggctcggctccgcgctccagcccatctctgctgatagatgtgtgtcatgctcagccgacttcactgtgcggcatgaacactcctccccaagctcattactggagtctcggaggggccttgccattttccaaaacggtgtcacatctggtttctaacaaccatttttatttctccagaggtccaagttttcatccccctccctgaaaacggaaagcagactgtattttgggaactcacagttcttttttgtttctgtttttttgttttttattattttttttttttcagagacagaatctcactccgttgcccaggctggagtgcagtggcacaatcatggctcactgcagacctaaactcctgggctcaagtgatcctcctactttggcctcccaaagtgcttggattacaggcatgagccaccacgcctggccctttttcagagttctttatgcacaatctcatttgttgctgcccccatttttatagaagaattcactgaggctcagacaggagcactcgcttgcccaaggagtcagagtcctctgactctgcaaaccaagctctttaaagccacactgcaaccctgtcgttaatggtacatttggacaactttttaaactgtgcactttacacagagtttcacaacctcggcactggtgacactttggggctggatcattctttacggggggaggagggccatcccatgcactggaagatggtcagcagcatccctggcctctgcccgatagatgcctgtagcacattcccccaccccgccaggtcatagcagtgaaaaatgtctccacacactgcccagtgtcccctgcagggcaaaatcacccctggttcagtgtattctgcacacagatgtgcttcaggttggcagccctgcctgctccgttgacccatttttttcagcatgtagcactgtgctgcagacactataatagaaatcccttcctttctttttctccccccacccctgccccccagacagggtctggctctgttacccaggctggagtgcagtggcaggatcttggtccactgcagcctccgcctccacttcctgggctcaagcgattctcccaccccagcctcccaagtagctggaacgacaggcgtgcagcaccacacctggctaattttttggttttttggtagagacagggcttctccgtgttgcccaggctggcctcaaactcctgagctcaagcaatctgcccatcttggcctcccaaagtgctgggattacaggcgtgagccaccacaccaggcctagaatccctttcagtaagacatgcagttgccacctctcctgcactcctgggcgaggggtgtgacgcttaacattagagggcgctgccccaccttgcacagctgtgtacctcaatcaggtgcacctacccagccctcctgtcggccactgctcaccgtgtgcacactctgggccaggtactgcgctggggctacagtgcagcacggctcctgccttacggaccccacaccctagttggggaaatgaggataaacaagaaaacaaatgcatctataggataatttcagagagtgcagagtgctgtagaggaaataaacagcccggtgactatagagggatgggtgaccagggacaacttctcatctgacctgaggtgccacggtgaggaggaggcaggcgtcccaggcagaaggaagagcaggtgccaatgctcggtggggtagagagcttggctcctagggagcgtgagacctagagaagttgaaacagagtgagctcagcagtgcgtccctgaagggagacggcctgatggctcttggactcagaagggccctctggccatttggggaagtctgggctctgggaaggctgcggaggcagaagtccagttggaagttggctgtgagaaggaaacaggtgaagaagcaagatgcatttctgtcttttttgggattttatatcctgtgtatatgtgtatgttgtgtattcgtgtatgtgtgtatatgtgcttttactgtattttcctgcatcgtgtatatgtacatatgtacctgtatattcatgcattgtgtatatgtgaatgttgtatatctatgcatgtgcgtatgtgtgccatatattaatgcatatgtgtatttttatatgtcatgtattcactcgtgtgtatatgtgtgttgtatattcatgtatgtatatgtagtgtatttgtgcttgtgtatatgtattcatgcatgtgtgtatatgtatgtgttgtatatttatgcaggtgcgtagatgtgtttgtgtgctggttccaaaatatgaggacaaattgccaaatcaaagtgaataaatatttaatgaaatggtgttgcatgattcagcgagtcagctctggaacatttggactcttagagagctgtttgtcgattacctttaatgtagtgtgtgggtggaaatggtgtgggatgaacatgtaccgaaagttgctgatgtccttaaagaagccctgttggtatttccagccagatggcccgtcgtgggggagagaaagtcctccgaaagcagcgggtgctttctgtcctgctggctgcctcttgggaggcccctaggacagatcaggtcctgtttcacccttcgcatgcctgtcagttcatccacgtgcatagcagtgggtgggggtgcactgtcgtttcattgccaacaaccacaggggacaaagtcctttgtggtcccacagctaggaggtggcagatccaggattcaaacccagacagtctgactgcagagacgctttgggcactctgccacattaccacctgtgttactgggaaaagggagaactgatgctgggaggaacagcgtgttcctacgccggcccggcatggcggggacatgtctgcagcagggagaggtggccgaggttcccagtggtttctggttgcaggagccctctgtctcccccattgtccgtggcttgcttagtatccccagtgatgccgtgtgtgcccctgtgccaggtttttcaccagctaatctcagtccctggtcgccacgagacacagctttcacagaccacaaatgcaattattacaaggcaatttcagttagatttggggctgggagagaaaacagaagggtctcctcctcccatcaggctccgaatcgttccccaggagcacttaactcagacaaatggggaagcagccgcgtggagcctccaccgtagagctgcctgcaggggaagtggccgacctgctgggccacgaagcagggtgcaggaaggatatggggagctagtgatcctctccaagggggcagggggactccattaaaccagatgttaacagcaagaagttggctataacaggggacgggcccattggtggataatgaaaatataacccttagtaggcacttgctatgtgccagttccaagcaatgtacagtcgtgtgtcacgtaacaatggggatacatgctgagaaacgtgtcgttaggtgattctgtcattgtgcgaacatcatggagtgcattacacgcctggatggcatagcctactacacacctaggctctgtggcgtgacctattactcctaggctacaaacccccctacagcatgtgaccatactgaatcctgtaggcggtggtaacacaatgggaagtatttgtgtatctaaacatacgtgaacatgttaatagagtacagtaaaaatatggtgggcatggtggctcatgcgtgtattcccagcaccttgggaggccaaggcgggaggatcacttgagcccaggagttccagaccagcgtgagcaacatagtgacaccccatctctactaaaaattaaaacattaggctgggcacggtggctcacgcctgtaattctggcactttgggaggctgaggcgggcagatcacctcaggtcaggagttcaaggccagcctggccaacatggtgaaacctggtctctactaaaaattaaaaaattagctgggcgtggtgttggacacctgtagtcccagctactcgagaggctgaggcgggagaatcgcttgaactcaggaggcagaggttgcagtgagctgagatcatgccactgcactccagcctgggagacagagtgagactccatctcaaaaaaaaaaaaaaaaagtggtttcaggtaagagtggatccccagggcctcaaaccagcatctctctatctctctatctcttgtatctctctatctcttctgtctctctgtctctatctttcccacctccgcatttttccatattgctttacacacacacacacagactcttccctcttggtggcaagatggctgccagcagcttcagttatgtatcccaccagttccaagccttgaggaagaagaccttctcttttctagtagctccctaaaaatcccagggctgactcgctgcagttggcccagcttgggtcacatgcctttgcctcaactaaccagtttgtgcatgatcaccaggggaatgcggtcctcatgggagtcaaggatttgcacacattcctggagtcaacagtcaaggtcagcccgtgcaacttaaataaggaagtgttggtgcccaaaggatgacagagccaggcaggtgaagcttccacctagtgctgggcacacaggaggcagtaagtgctctggcctttcagcagatgccagccctgctgcccaggggcagtcgccagccagctcattgtcaatggcctttcctggcctgccattaattcctcttaatctgcctgccaaattttcccacccccacgccagcccccagcttgcccctcctcttgtgctgtccttgcctcgaaagctcagcgaatccaagcttcccaggcaccagccacctgccacaatttgggctgggcttttaatcttggttttaattccagctcattctcttggctgtatctcccagcccaggagccccggggcccatgctaatttgcttctcccacctccactggtgccggaataaccatttttaaaagtgccttggggaaatataatcaaatgagagcaaaatctaatttggcactaaaagcctctgactgaagccctgttttctagggcctggtggagactgaataatacaccctttttgggtttttaagggttgggggttggagaaaggaaagagacgtgaaaggggagatgctagcagaggaaacagcttgcattaagctgacatccgtggcactgaaaagaatgggcaggaggaggacccccacccactccctatgaagaaattcatatcccagcagccaagccaagaagctaaactccagcattcatcagaaagaccttggcccaagtcttcaagaaccagtaggttcactggctggagatttggaagatgtgggagtgtagcgggaaacccagttccccagtggggagttcagtgaagcctttttctctgactttcagttcacttttctgcaaactgagggggtgaaaatctgtgcttcttaaatgacttgtgatctgggctcctttcagaatgtgtcaaaagctgtggacttgtttccaggaaaatgcacaaaaggcaaaatctggcatgcaatgttccaggagcggtacgaaccctgccactcctcatgacagtctccaggaccctatgggatctgtcccctcttccccgtgatgtcatttcctccctccctcactgtcccccttgggttctgcgatgcccccacgtttgtactggcttcagggactttgtacctgccaattccctctgcctggaacagttttcctcctatcccctctgactcttgctcttcagcccagcgaggcctctcacagcactgcgtggggccactctgtcctatcattctcctttattttcttcatcgcatttgtcatcattccccactagaacatcaactgcacgagggcagaagggatcctggtggtcttgttcactcctgtgattccagtgcctgggaagctccctgcataccgtaggtgtttaatcaacacttgccgaatggatacaggcatgcataccttccctagggcagtgggaccccaaattcagcaatttcgagtgccaccatcatgaggtgtaccatgcccaggtacactgattctgttaacattttaccctagattgtttcactctggacttcagttgtttcaaaaggaatcttttacatcactgacagtattgtttgccacgagtagaaagtgtcggggctctgtaggggtgtaacaaaaacgcaggtaataagagcgagatctggtataaagaaagtgattttttattccaaagctagcttaggggaagaagtacagtcttcctgccttaagggtactgctttgcttttaggagcagaaaggagttgctttttaaaagggggcctggcatgaatggcacacaggggaggaattgagtgctgggggggtccgcatatctcactcgagtacttcatctaccgggaagtcagctggcagccactggtgcctttgtgggtggaactaggttgtaagggtggccagaagctctccacctgggagggagtttcgcagcaggcatactttgggttgtagtggaccattgtctctcgaggcaacctcccagtgagtgagagttccgctccagagcctctaagcacgtgattagatgaacttgccctgaagagagtgtctggtgtaggggagataaaaggttataattgcatttctaaagggcgaagtggggcacggggaaaatggagaaaaaagaagaataaaaaataataaaactgccggacagggtggctcacacctgtaatcccagcactttgggaggctgagatgggtggatcacctgaggtcaggagttaaagaccaccttggccaacatggtgaaaccctatctctactaaaaatacaaaaattagccaggtgtggtggccatgcctgtaatcccagctactcaggaggctgaggcacaagaattacttgaacctgggaggcagaggttgcagtgagctgagattacaccactgccctccagactgggtgacaagagcaagactccatctcaaaaaataataataataataataaaactcatctttttcttagaaaaaatgggaataccgatttatgtgggggcttattaaattttaccctcttccttgttgaggtcctgagccgattaagaaatcagacccaagagtcagctgatgaaagtcaacactgcactctgatgaatctggtgaaggctgggtttgagggcatggcttccttctgagagcatttgggcttcctgactaaactccagagtgtgacagacttcccactgatgcaggtccacacctctcctccccgcgcagacaggacaagcctcctgaaaactagccctccccgggggcagctcagtccccagaggaaaagcaagggaagggattgggctatgcatgcccacttcggcccttcaaatccactaggcacatgctaggggtcagcaaaccacagccaatggacctaaccaggccctccatttgttttagtaaataaagttttattggaacatacccgcccacttgtttatgtcttgtctgtgacttcttttttttctttctaacaatagggtttagcagttgtcacagagaccctttgaccctctggcccacaaagcctaaaatactgactatctggcttttacaggaaaggtttggtgacctctgctgtatattgtccccctcggaggaggtacgggagagcatggagagaggccaggagtgttacagaagtggagcccccccgcatggagggcagcgttagaggtgggggtcaaggtcacaaggtttaggaaatcttgtttcctgaactacacttggtctccaggggccttcctggctctcacaatatggctccaaagacctgaggggtgagatgctggagggttggaccataggcaggtttatttaaataagatagggtttctcagcgacgtatggtggctcacatctgtagtcccagaactttgggaggccgaggcaggtggatcacttgaggtcaggagttcgagaccagcctggccaacatgatgaaacctcatctctactaaaaatacaaaaattagccgggcatcatggtgcacgcttgtagtcccagctactcgggatgctgaggcaggagaatcccttggacccaggaggcaaaggttgctgtgaggcgacatcacgccattgcactccagcctggaaaacagcgagaccctctctcaaaaaaaaaaaaaagaaaagaaaagaaaaggtttcttggattaggcgctgctgacattttgtcctggctcagtctttgtagcgtgggggctgtcacgtgcgtcggcgaatattgagcagcatccttggcctccacccaccagatatcaacagcacaccaagttgtgatgaaaccaaaaatgtctccagacattgccaagtgtctcctggggacagaaattaccccctttctggccaagagccactgctttgaggagctggatgcattgaggcatctccaacattccaggtcccagagaaagagaagtgcaggcctttagcttgcccgggaatctcatgctgcctccactccatcagttactccctgacacctagccagggacgcccagtcgctgtttaattaggcacccaccacctaattacatttcactctgtgaaaactggatatgactcagactcagagactgcagccggttccccgcctcctcctctgcagaacgccaggttcttcccgtttatttttgctccatcctcccacacaaagggaggttccatcccggaccttacccctgaggctgctgggggatcctcccttcctattttcacctcccctgtgtacccagacccttacaggaggtgtttcatcagctcctccctctggagcggtcacctcccggccctgcatgatgggcaagtcatttaatgaagtgctcccctttgccttgtattttgggggtttcagaatccagccgcttgggttcctaaggggttttcccactcctggaaagtgtcagccatctgccaggtcaccaggaaaaccgctgcagagggagccagctccatcacagctcccccagggccaggtggctctgtgctttctccaaggacactggtggataggttgtcctctcctctaggggcaccagagccccatcccacccactctcctccttcctctgggggttcacctccctggcctttctctcttcatcctggcttctcggccaagcactcacgtgcacaaggcccagcgctgagctgtctgttagcaagatctccttacatccctacaacctcctggaacgctcatattctgtgctctcagcaatactcgtcagaaatttcagaaccgcagtgtcctcatctagaaagagacgactagaataggattgctgtctctagactcaaattttcccatttcttaaatatggctttatagattataattattaaaaattatacatgcaagccagacacggtggctctcgcctgtcatctcagcaccttgggaggctgaggcaggcagatcgcttgagctcaggagttcaagaacagcctgtgcagcatggcgagaccccttctctacaaaaactacaaaaataagccaggcatggtggcatgcgcctgtagtcccagctactcgggaggatgaggtgggaggatcacttgagcctgggaggttgaggctgcagtgagccgtgatggtgccactacactccagcctgggtggcagagtgtgacgtgtctcaaagaaaaaaaaaatgtacatgcaaaataaaaacagaagaggatcatgaagaggtcttgtctgtctccttatcacagagcttttaggcacatccccttcctgatgaattagggtgattttctttaagctttgttgttgatgtaaagcgtgcatgtggaaaagtgcatggctcccaaatctccaggccaatgaggtgtcaccaactgaaccacctgctccagcaagaaatagaacaagatcatcacccgagaaactccccttgctgctcccagccaccctcccccagtctccaggatacccactgtttttattctaacatcatagattagtttggcctgttctcaaatttcacatagatgacgtcatatggcatgtattcttttgtatctggtttatctctcttaacattcttaggttgttgagatgcatccctgttcttgaatgtagcactaggtctttcgttcaagtttcaatgtagccttccgttctgtaaatatgcaacaatttctttacccatccttttgttgataaacatttcatttgtttctacctatttactattacaaatgtgctgtcatgtcttgtacctgagtttaggtgagtgtatgaatacttttctgttgggtaaatacccaagatttaaattgttgggtagaagttaccaatgcattcaaatttagcagacacagccaaagagttccccaccgtggttggaccggttggggcagccactcagtgtgtgagggctcaagttgtcccacatccccacccatactaggtgttgcccatttctttaatgttagccattctggttgctgtatagcagacagaatccaagggatccacaaacttcaatgggaaaaaaagtgacactctggttttcactaacctacagctgagacttagcatttgcttccaatatgagcataagccataaaccacagtatgttggcagaatctgtagctttgtcatctgtagaaatcaccagtatttaatatcccattgcagtttttgcagatactgcaaaatataatattttcactcataactattctgaaatgatcgctctctacaaggttttaaaagacacagtaggccaggtatggtggctcacgcctgtaatcccaacactttggtcaggagttcaagaccagcccggccaacatggtgaaaccctgtctctactaaaaatacaaaaaattagccaggcatggtggcagacgcctgtaatcccagctgaggattactcgggaggctgaggcaggagaattgcttgaaacctgggaggcagaggttgcaatgagccaagatcgtaccattgcactccagcctgggtaacagagcaagactccatctcaaaaataaaaaataaaagacacactgtatcgcaaatgtgtttagtattttgataaccgtatttccaaacaattgattttctctgtaatcctatatcttgtattcaatgcacgtaataacattggagaagggatccattgctctgtgtgccagagggctccatggcagagcaggtgtgcatgctcaggcctcggacacacaatagtttaataaacatcgtcaggcactttctcacgtggcctcctgatccatctccctccgcagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggtaagctgcaacctttccagcctgggagtggctgtgtggcccagcagttagaggcccaactcaggagccagactacttgggttcagattgtgactcaggcacttaaaagtgtgaccttgagcattttacatacacctcctcctcagtttttcatctctcagccagggacagtggctcacgcctgtaatcccagcactttgggaggctaaggcaggtgaatcacttgagtccaggagttcaagaccagcctgggcaacatgacgagaccctgtctgtacgaaaaaaatacaaaacttagccgggtgtggtggcacatgcctgtggacccagctactagagaggctgaaatgggaggattgcttaagcccgggagtttgaggctgcagtgagccaggatcttcccactgctcttcggcctaggtgacggagcaagactctgtctttaaaaaagaaaagaaaaatgtattcatttctcaaaaaatagtgtctgtttccaagagtttggttttttaacattttgccgagacagaatattcttacagaaagtacatacacagagtgtaccattcaaaggcttgccgcacactgaacggacatgtgtaatgagcacccgggtaggccaagaagagaatgtcaccaccgcccgcagcagtcccctcacggaattcccccgactcgacacccctcccgcgaggataacgatgattcagactcttagcgttacagattcactctgcatctggcttctcctgcttagtattatgttgagttcattcttgctgcccagcattccatcatgcgcttataccacaatttgtttatttcttctacttttattgggcatttaggtatttccagtttggggttattacaaatagcgctgctgagcactgtctagaacctagctcctggtgagcatagaggctcatttctgttatacccgttcctcacagcagcgttgctgagcacagggcgtgtgcatgttcggagtgagtgggtgctgcctgagcacctgcagcagtggttgatcctcagtcgtagttttttctgtttttaacataagatgaattgacatgaggtaacatgcacagatcttaagtggaccgctggatgaattttcacatacgtgtgcatctgtttcaccgcgcatctcttccacatatgcgtgcatccatttcaccgcggctccgatcaagacatagagcacttccagaagactccctgagacccctctccagtcatgaccccccaccctggggatgacgtctactctgacttctgacagcgtggattatttttgcctattctagaacttcacctaaatggaatcgtatagtctgttctcttctgcatctgccttttttcacccagcgcaatgtctgtgagatctgtattatttattcattcaacaactcatggacattttggttgtctccagtttgggtctattataaactaagctgccgtgaacatctttgtccatggcttttagtggacatatgcacccatttcttttggttatacacccaaagaaggattgctgggacataggatgtgttaagatgttgcgcccggccaggcgcagtggctcacacctgtaatcccagtactttgggagactgaggcgggtggatcactttaggtcaggagttcgaggccagcctggccaacatggtgaaaccccgtctccactaagaatacaaaaattagccctgcgtggtggcgggcgcctgtaatcccagttactcgggaggctgaggcaggagaatggtgtgaacccgggaggcagaggttgcagtgagccgagatcacatcactgctctccagcctgggagacagagcgagactccatctcaaaaaagaaaaaaaaaaaaaaaaaaagatgttgcaccagtttacactccagccggaaatgggagttgccctgcatcccttatcagcacttggtgttgtcttttttgtcagggctgctttgttgggcatgtagcggtgtttcattatggttttaccacaaaggtttttgaggatcacgtgagttagtacatgtagaacattagaagcgccccttgcacgtagtaaatactcagtatgtagtagcttagatcagggcaacaaatattttctgtaaagggccagatactaaatattttaggctttacaaggcttacagtcctgttaccactgcagaagtctgccgttatagtgtgaaagcagccatagataatatacaaacaagcatggccatgctctaaggaagctttgtttacaaaaacaggcagtcgacctgcttggctgtagtttgctgacccctggcttagatgatgaggaggagaaggaggagaggctgacagtgatgtttcatccagatgtcccattttaaaagaaatatggaaatgaacaaatcttcctgccccatctgaatcctcagagtcagctctgacatccccccacagctggtacattctttccccagaccagctgccaaatccatccctctttctcttttcccatccccactgccaccagtcctgggccctgcctactgtgacttcccaggttaaagtcactagagaacaggcagtcactgaaagagggtagcaagccaggagtgtgtggacaatagggagtggtggagacggtggagaaggtgtctgtccaaaaggggcagatcaggcccaggtagaactgtgggcccagatggccacttttcctgatttttcaacagaagccacaaatttgtattttttacctatgaaatctcctgattggtaaatattggcaactaattcagacttttctaaaatcttgcatcaattgagcatgcctgacccatgggcctgcagcccttcagcccaccatgtcgttcttctgccagcaccctccggggactgtacggtgagtttcacatttggagtcagtgggatcaagttgagagccccaaccttgacacatattacgtgaccttggacatgctacgtactcctaagagcctcaactcccaaatctgaaaaacaagcatacccttgcatacttaatcatgtgtacttccatttactgagcacctactgtgtacccctgagcacctactatgtagtgctcaggggtacacagtagtacttctgataacatgtagtacttctgatattcacaacaatcatatgaggggagtggactagtcacatttggttccattattcattcaccacccccaacaagtattcattgagagcctgctgtgtaccaggtaccatgccaagtgctggctattccaaggtgaatgaaaacagatgacccaatcatggtcctcctggagctcacagtctggcacatgaagatatgatataaactgttaagtgatgtgcacacatcattaatgcacacacacacagtcacatcacacccgtctattttgtcatccccagtatgagccatttcaacctccaagcttgctagttattacagtcatctcagttttgttttgttttttgagacagagttttgtgcttgttgcccagactggagtgcaatggtatgatcttggcttaccacaacctctgtctcctgggttcatgtgattctcctgcctcagcctcctgagtagctgggattacaggcatgcaccaccacgcccagctaattttgtatttttagtagagatggggtttctccgtgttggtcaggctggtctcgaactcccaatctcaggtgatccacccacctcagcctcccaaagtgctgggattacaggtgtgagccatggcacccagccactatagggtaattttttttaatcagactaggctcttgaagttgtttgtgaacagaaatttaactcccagtggcttaatcaaagaggaaatatattcacctatttaactgaaaaccagctataggggtatcaggcatgggtggatccaggagttcaaatgaacccccaaggagttgatttctctctactgtcagctctgtttttgtctgctcgactgtattcacagaagctctctctcctcctggtagcagtgcggccttccttatatcctcccagcttcctggccagctgcaagcatgggagtctctttcccaggagtcccagagagtctcagtgcatctcattggctctggatcagtcccatgtctgtccctgagccaatcagagtggccaggaggatgcctggttccctggactataagtcacatgctccactcctgagccagacatgggggtagcaggagctctacgctggaacgttggctgggaatagagccccaaataagaatggagtttccaccaggagaaggctgactaggtgctcaacggccaaaaaacactctgtcccacttctgttctggaaaccccggcacacatggagatccctctgcctccgacaggtcatcctgggctccctgtaagtctgatgggtccaggcccaagtggcagaagccgcccccggcctgccctcaagtctcattctgcacatagtaggcctccagcctcccaagtgaattaattccaaagttctgatgaggcagtccggcatggactccttggaatataaattccagtcccagggctaagcacgctgtttccctcctcccagcctcagtgcaggcggattctctaaatatcctgaaaaatacattccctcctttttaaaattcttcaccacatccacgcctcatctcagagcagcccgataatcaagttatcccggggtgctcaggattcttttggggctaagcatggggacatagaacgtccgtccttttgccctgtttcctgcccacacacatctccccctgtgaatgagaacagccctgtgagggaggcgtgagaggattcctggccccccagttaccaggggcctgggaacagagatgctctaacagggacgtgggcagagggcggggcggtgaagtcagaactggctcaggtccagggttcaaatcctgagggtagcagtgggcagcaggagcccaagcgtcaagggaacaggggtgagcccggggtttccagccaaggcagagctcaggagccctgtgccctgggccctagatcaggcagtaagatgcctctggcaaggcagaatgtcactgctggcctcgggcgggccttgttgggaggcccaggcagggaggaagcggcaacccttcgtaagcccccctcagaaggcctctgaggactctgtcccaagtcactaatccacagatgggcacatgccaccaaaggggtccagatgtcaagggcagaaagagaggcagtggtgatgagaaaagagtgatacaggacaagcgctaatggcagaagagggttggagaggggaagacagttgttagtgggaagggaagtgagaatgacctagagttgagtccacccgaaaagaggcttccaggtagctggcaaaagtgggcctgggtgttgggtggctctgcagggaggtgatggcagtgcacggccagtgtgggggcgacctggcagattctatgaacttcatgtgccccgccccttgccgcagcgtgtacacttctctgtctatctggagaagcctcagtcataggcaggagacggcgtgatggagcagctggttgtagctctgtttattactgaaagaaattagcaaagtccaccaatacacgaaataactaaatgaccgtgaagcatccctcctctggaagatcctcggcaaaggatgaggccggtctgccttatgtcctgagcccatcaggcagagtgggaaaagcaagttccagaactcctgaggtccttattcaaatgtcacctcactttagccttcctggaccaccttgtataagggcacccccaccacactccttactgcaacaaatcaccatctggtgcattacaccctgtgtatattactgattcatttgttaagtatctgtctcttctcataagaatataagccccatgaaggcaggaatgctcatttgttttgttcactgctgtatttgtcagatagataaatgaatatgtacagtatgatgtgattaataatataaaaagatgcataaagtgatactataatgtacctaacaaaacactggaaaggttattcccagtaggggacagaagagccaaggttatgggggtgggggggtggtaaggagtaatctaatcaaatgagacttcactgtcctttgtactattttaattttcacaaagaaaatgtaggcatatggttcttgaggaataatgactaacactcatttagacataccatgtaccagatactgtttgaatcattttacacaaattaacccatgcatttctcatcatagtctgtgaggtatatactgtgtctattcccaactgtcagatgagaaaactgaggcccagagaggctaagtaatgtaaccgggccacatagcctagtaagtgataaagcagaattcgaacccaggccatctggcttcaaagtccatgcactaaaccacagcccgtgggcccagactggtggtttttgtatggcccctgagctaagaatggtttttacattttcaactaattgaagaaacaatcaaaagaagagcatttttcacatggtatatacaaaaatgaatgtcattcagcctttaaaaaggaaatccggccaggcgcagtggttcatgcctgtaatcccagcactttgggaggccaaaccaggcggatcacttgaggccaggagttcgagaccagcctggccaacatggggaaaccccatctctactaaaaatacaaaaattagctggacatggtggcacatgcctgtagtccagctacttgggaggctgaggcaggagaatcgcttgaacccaggaggcagaggctgcagtgagcccaggtagcaccactgcactccagcctggccgacagagcgagactctgtctcaaaataataaaataaggaaatcctatcatatgcagcaacatggatgaaccttgagaacattatgctaagtgaaataaaccagacacagaaggacaaatactgcatgattcccttacatgaggcatctaaattagtcagacaatagcagcaaaaaggagaatggtggttggcagggctgaggggagggggaactggggagttcctgttcaagatgtatgaggtttcagttatgcaagatgaaacagttccagagatctgctgtacaacatggtgcttagagttaacagtactctacttcacagataaaactttgttaaaaagcatacagctcattttttttttaccacaataaagcttttaagagtaattttcatgacatgtgaaaaatacatgaaattaaaactgcatccatacataaagctttactggagcacggacatgcccattcattttcctgatagctgctttcaagctgcaatggcagtaatgagtagttgcaacagagacagggggcctgcagagtctaaaatatttactgtctggccctttacaggaacggtttgtgcatacttgctctaaaccactatgtatgcttctcattaataatgttatctgtggcggggagaaaaagatggacctgacccaaaaatacaaaggccttggctccagctctggatgcatggcttatttgtttggggacctcacttccttatctgtaaaatgggtataatgtccacttgtcaaagttgctgtgacgatcagctgagctaaggtatttgataacatgaagagcctatgatcattcattacgagttgtctggagcctgtggagctgctgccacccacacgcactgccttggccttggagggaagcccggtgcggagtgcccactcgagggaaacacgcttttgcctagggctgaggctggcagtctccgcagacactagctactcagtcggtgaagcttgtggatgcctgcaggaatcacctgaggctcagagggtgcttgccagagggggccggttgcacctcggggtcccagctgtggcttctcagccctgtggagctgtgcaggccagcagcacctgggtagagcctgactcctgggcgccgggttctggaaaatgcacctgggcctgtggacctccacccatctcaccctcctgctcacaggtctgaatttcagagttcttcctcatggcttgacccgggcaccccaaacacagtttgcccatctctgaactcagcctttcccccggcccaggccttctctacccttccctcaactgcccaaaccagagaccaacaggggtgggggtcacccgcccctcccgcaccccacatccacccagtggctgtcctggctgcccctgagcatcgctggatgctgcccccgccaccctggcccaggcctcctgttctctccctcagagagaacagggcatggctgaagccctgtggccggagggatgggtggctcttgttggctggcctggcactaactgcccactggtggagcagggtggcagctttggaggcaggtgtgtcatgtggcattgcggagctagcagagatcggggaagacttagccgaggagtggccactgaggaggatggataaggaggggagctctcagacatggagaaatctgcccagccaccaagacagtcctgattcttagctgaatggtggcagagagctggctgtgcacaggacactatggcaagagcttcacatctattggtgctttaacctgcctgtcagcctcaagaggcaggtactgtaatcaccccccacacactttgaaacattagactgtgggagcccctgacccaccctcctgggtctcattcctgccccggcctgagccctcccctggaggtagccagtatcctggagcttctacccacacatacctttattctttcatcccataggtggatatctcaaacaatgtacgatgctgtgtttgtgtccttagactttttataaatgatatcatatcatacacatccttccacaacctgcttttctcacccgatataacattgtaagatttatccacgtttgatccgtgttcatccacgtagctctgttctttttcactgctttagaatcccattgtatatcttctcctaggaatggaggttaatggtagctttatttttaaaaaagtttaaccacggccaaacaggcatatagttctaagatgaagtagtgaagatgagtctgttatgaagagcaacggtggcttcccaccccaccccactggcgggtggcagcaagtgtccaccactggcggttccatctcattctcatgccatttcctgacttgaccccttcaggccctgactgttgatgtcagggtacagagctttgcaccatttttagatccattgtaaattacctttgtcattttaagaacttttctaatacctttatatcacgttccaaaactatagcagcagctctttgatttatataacatatattatttttatgtaataaattctgtagagcccccttataaaattgtttttactccccaaaattaatccataaataatattcaaggagcaatatataaagaagcaagtaactttctccgcttctctcctcttcccagtcttcaatcagcattttgatatccttccagatttttccttgatgctcaaaaatatatgaggttagagtttggtttctcctcttcaccttcccttccctctgcccccacaaaaaatagaatgtttctgagtttgactctgttgcttgctcttacccttaaccatgtatcttggacaactttacacatgcctttttaatgtctgcacagcattgcatagtatggaagcaatgccaccaggtgtgttggctcatgccttaatacctacactttgggaggctgaggcaggaggattgcttgagaccaggagttgaagatcagcctgggcggccacttgctagctgtatctacttgggctaaccactgttagatactcaagactctgtctgtagagaccctgtctctacaaaataagaataaaaatgaaaaattagctgggtgtggtggcacatgcctatagtcctagctacttagaaggctgaggcaggaggatcacttgagctgaggacctcagggttacactgagctatgattgtgccactgcaccccagcctgacagagcaagaccttgtctctaatatgtatgtgtgtgtataatatatatacatgcatactgttaaacatatatcctcctgctggtcactgcaatgtttttgttttataaacaatattgcagtggccattcttgtgcatatggatatagtggatgagtgtacctgaaagagtgtctgtagatatatgaatacatcatggtatgtatatatgttgtatacttcagggtggaagctgtagacacctcttcacctttttttcttgaaaataatcactttttgaaagtaattgttttgggcagagctgctttctagcagagggtatatttcaagaagtcattaccttgaagaaagattagcagctaaatatttactaaattcaggaagagttgtatgggtgctgtggctcacgcctgtaatcccagcactttgggaggccaaggtgggaggatcacttgagcctgggagatggaggctgcagtgagccatgatttcaccactgcactccagtctaggcaatggagcaagaccattgctccattttttgctccatgaccaaaaaaaaattaaagagtataggcaaacctcaacttcttagctgagcttttaaagcctccagttctggccatttacttttcctccaactcttctctcctcttgcccaatatgtaagtcagttccttattttcctggagacattactgcatccccatcccttttttgtgtgtgtgctgctccttatatcatttctgcattttaccctctgacattttatcctctttccaaggagccagttgccatctgccctctcttctatttttagagcacatggcaagcacattcctgcctcagaccccgttatctctgcctggaactctttcctggatcagtgattctcaatcctgagtacccattagaatcccctggggagttttttaaaagtctgatacctgggccaaaccgcaggccaatccaaccagaatctctgggggtgggcccaggtatcagtaagctctccaggggattctggcaaaatccagtgatacatatcttcctatgcccagctccttctcatcattcaggtctcaactcaaatgtcacctcctcagagaggacctccctgactgccccagctaaaatatgcccctcacctcagctcccagttactctttgttacatctctctgttttatgatatttccttcatctgtcataacttttaactaccttggttctttatttatacatgtgtctgctcctgccccagtgtaggcaccccagggacttagggatatacccaccctgcatgacagtgtccccagagccttgaaaaaacttcagacttaggagccaagactatgtagtgctgggtccaacatttactagctgtgtgccattgggcaatttacttagcttctctgtgccttaatttcctgttctggaaaataaggattatcatcatacgtactttctatagttatgtcagaattaagcgagcaaatacaggtaaacacagaacagtccttggcacatcgtaagcactcaatagtgttagctattattcttttaatatctttttttttttttttgagtcagagtcttgctttgtcacccaggctggagtgcaatcatgcagtcgtggctcactgcagcctccacctcctgtgttcaagcgattctcctgcctcagccttctgagtagctgggctacaggtgtttaccaccacgcctggctaatttttgtatttttagtagagatggtgtttcaccgtgttggccaggctggtctcaaactgacctcaggtgatctgctcacctcagcctcccaaagtgctgggatcacaggtgtgagccatcccacccagcctattttaatatctatctaaagtgatctattgcaattcctgccctgttctccctatccacttctctgctttatgtccaattagcttagcaccatttgcatcatttgtctggcatttcatttattttacttgcttatttcttgtctgtctgctccctagactgtcagctccagaagggcagaaattgttttgttcactattgtgtccccagtgcctagcagggtgcctggcacgtagtggacaccagtatgaatacctggctcctcacctgttctcctgtctctccccaccccccaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatgtaagcctcagcactctgcctgccagaggcactgcttagcatgaagggggagggtcaggctttagcaacagtactgtcaccaccatgacttcactgtgcctcctctctaatcctcctggtttaaagaccccaagaacatactgcttgtccatggtgaaactgggatgcaactccagacagcctgggcaacagaccaaggcaggagaatttttaacttgggatacacggcctcccaccaagaggtgtgtggatggaactgcatagaataggtttccttttaatgccatgtgtattttatttaagacatctaaaaacattcttttgaggagggggtctatagttttaccagactaattatttgccaccatttattgagctgtgggctatgtagcaggtgctgtgctaagcccttggcattattgtccagtccctgaatattcacagtgacccttggtgtaccagttatctattgccatgtaacaaatcatcccagaatctagcaacttaaaacaacaaacacaaattatctcacggtgtctgtgagtcaggaatctgggagtggctgttctgagcttctggcccagggtctcctgaggttgcaatcaaggtgtcagctggggctgcagtcacctgaggcttgactggggctcagtcccatggctgggtcttgccacaggagcctctgtccatagggtgtttgagtgtcctcacagcatgatagctggcctcacccagagcaaatgatcagagagagagtaaggccaagaaggaagccacagtgtcttttacaacctaatctcggaagtggcaccatcactgtgccacattctattggtcacacagaccggtccttctacaatgtggagggtctacgcaggggtgtgaaggccaggaagtagagattatcaagggccatcttggaggctgcctgtcacacttggtattcccattttacagatgaagaaactgaggcacagagaggtaaggtaacttacctgaggtcacccagctctaagtggcagagccaggattcaagtccagccccccacttctgcttcccatgcctctgcccacccctgtagtactctatccagctggctgggaaacttcctggaaagttctcctgcttctctctgcctcagaccaccccctgcttagcagtgactcagcagcccttactgtgacattctggggctgcaaggatggggtggtttggaatctgcctgaatattcagggtgtttggcttcattacaatctgaatacattgccctcctcaagcccctcctgtaattactttttgacagacctcgaagcagctcagagagggtaccgaaggcactgttcaccttcccatcccctgatctctggggaggaggctttgacagaagacgatgagctgcgtcccaggggctgcagcattgctgctgtgcacatctgtctggctccccctccaaacccaagcccactcctctccacccaagaaggccagcctcccccagcagccggcaccccgccctaccgccacttagaactcatccctgcagcgggtggaggccactcagccctgtctaagggagaagccgtgggtgagggaagggacgctttgcttcggcagcatctctaaaagaggtgccggcttcaccccaaacagcagcgagcggtgccggaatttcatgatgaaattgtttggcattgcctgctggtttattttccctttgaaatgaaaattacagaaattgaaaatgagcagtgtctgctcttatgtggagaagccccctttgccttcttaggggcatgtttggaaggctgtctcatctctggagtataatcatttccgaaagaaaccaaaaaagagaaagtcctgcagctaggatgttaaatgatgacagtcaagaaggggtggagaggggacagagccggggcgcacggttagagcactggatctttctgttaggggtctcctatcccatctctcccctagaaagccggcacatgccctttcctggggcaggccttgtgtactctggcaaaagttggtagatggtggtaccatccaccccgcagaccccagggccctgcaccctccccatgcacccccccacacacacagtcacatacatacagacacacacaaagacatgcaaatacacacaggcacacaaagacataccacacaagcagatacacacaatgaaacacacacaagcctgggcaacttagtgagactctgtctctacagaaaatttaaaatcagccaggggtggtggtgcacacctgtagtcccagttactggaaaggctgaagcagaaggatcacttgggcccaagaggtcgaggctgcagtgagctatgattgcgccactacactccagcctgagtgacagagtgagaccctgtctcgaaaaaaaaaaacacacacatgcagacacacaaaaatacacagttacagacacacacaaagacatacacacacgcaaacaaagacataggcagagatacaaagatacacacaggcgtgcccacagacacagcccaccagccctcagagcttcccttcaaagggcgctgattgtggcttcaagggctttggggcgagggatgttggggctgctgctgatggccccagacacacagtggaggggctgtgaggacaccaccatcttcccgccatttccccagcagaagggaagggggatggtcttcttcacgcccttttgtgaacgcaccagatattcctcggatgctggaggaggtgaagttttcagatgtttgttgaacaggcagctgggcccatgggaagatgccgacatcctccctgggggagcctggcttgacacaggcaaccagcaagctggcgtcgaccccaagcaccacccggctctgctgccttctggcctcagtgtccttctccaaaagcgctctctccgagccggggctgcagaaatcatcatcctctgaacagtcacccctcactgttctcgagggccgatgtcagcctaacttctcatggattcagggatgattgctgaaaattgcatcctggaatccgggcccttgggcctgcgggaccaattttcccacacgctcgctgctctgagagcgtctctgtccgactgctgcccccagcagccccctttcagttcctcggtgggagagatctgagaggggagctgagcttgttcctgggaatgttctacatggcgggtcaggccctgagacagcagagccagcccacaggagagcctggccgttctgtaatgaaaggaagcatgggccctgatggattcagtggcatgaggctgcagatcagccaggggctgagaaagccgagtccaggggagccttggagacagtgactcacctcccgccttacatagcaacggtgtccacagctgccaagctaccccagcggcagcgtcacaatttctgccccggacgattgtgatatctgagacgctgctgaagtcccgacgtaccaggccagagggagacatgtctgtgcccctctgaccaggcttgtttttcctcctcttcttcgcgggagctccttgcccccagaacacccactgtgaaaagcagtggaaactcaccctttacttcagccttgactgggaagagaggccagatttgcagggaacctggccttcaagaaccatcaggcccagggcgaggaagcccacgttttgtgaggccttaaacagtgcctcctgtcaatggtgcaccccacccaggagactcccccatgctgcggttttcagtagctcggagccaggggcccggcataaactgaggtgacaaggaggtgctcttggtttgctcacaatgtttcctctggttttggtttaatctcccattgactaaccaggaaatagagaggatcagagaagtttggggacctgcccgctgtctcacggagtgagtgacagacccagtgtacctgacttctgccgtggagtcacccgtgattactaatgacaaagggacacaccaatgataacctctcccaagcagtcatcacgcactggccatggttagaagggttccccttacagcctctccctcagtgctcacaaccttcctgggaactggcactgtctgtattctccttgggtaggaaatgagggaactgatgccttgggaggggactaactggccaaagacagaactggggctcgaaccccagcagctggtatagtcaaccactgccatgatatcatcatagatacctgcttggggtccctccatccctcacatcacaggtgctcagacagaactttgcccaacacactcctgctgcacgattaagcagcatgccaggtgcagtggctcatgcttgtaatgccaaaactttgggaggccaaggtgggtggatcacctgaggtcaggagttcaagaccagcctggccaacatggcaaaaccccatctctactaaaactacaagaattagccaggtgtgttgacacaagcccgtagtcccagctactaaagaggctgaggcaggagaatcacttgaacccaggaggcaaaggctgcagtgagctgagatcccaccactgcactccagcctggaccacagcaagactccatctcaaaacaaagaggccaggtgcagtggctcatgcctgtaatcccaacactttgggaggccaaggtgggcagatgacgaggtcaggagatcgagaccatcctggctaacatggtgaaaccccatttctactaaaaatacaaaaaaattagccaggtgtggtggcacgcgcctgtagtcccagctacttgggaggctgaggcgggagaatcactcatactgggaggtggaggttgcagtgagctgagattgcgcccctgcactccagcctgagcgacagagcgagactgtctcaaaaaataaaaaagaatgtggcatgtcccaaatgtgcacattcaggtgccttcctcacaattctggccttacacataaaactatgacttatttcatttttaaatccatttctattatttcaaactaaaatctattgcaaaaggatattccgtggtcctaccttaaccacaataactgccacctgccattcaccaaaggtaactgccatctaccaataataggtacaaggcacacaaagcaatgctatggaatttgagttgggtactggttcccgatgaaggctctgaacttgactttcttcccttttttcaaaaggaagacgagcaaagtctagagaggtgttaaagaaacactagcaccaaacagactttgccctgagagagccgacaagggactggctgtctcactttgtcactcaaggtcactgaatgctgtgcctcttaggagcttcccaagtgcacacttcacacgtggagaaacgctgaaacagggtttggataagcccctgacatgccaatgtcccctttcccaccaggagatcacacctggccctgggctgcagacacagcacagggtggctgctcatccgggcgggtctggcgggggccaggcagggtccaggctgtccctgggtttgaccgatgtgtatgtccttgcccaccagcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacggtaggcgcccgctgcatgcctcttggtgggcgtggctccgaacccccagccaggccagggccgagacctcctggcccttcagggttttcctggaggaatagaaatcaaaggcagaatgaagaggccccatgtgctagacctggggaacagcttggagcaatccagacaaaagcctcttccttcatgaaacattttctagatctgtgttgcccaatacggtaaccatatatgctagttatattttttcctgctatttacatttttgaacacatttattgggatgtaattcacataccatacaattcccccaattaaagtgtgcaattctgtggttttaatatgcccagagttgtataaccatcaccacatccatgttaggacatttttcttaccccaaagagaaacctcacagcccttagatggcccactaaatctccctcacccccagccccagacaactggtgatctctttctgtctctatagatttggtgttctgcacacttcctataaatggaatcgtacacgctgtggccttctgtgcccagcgcctttctttcacttagcgccacgtgttcaagcttcacccctggtgtcgcatgaatcagtccccctcattccctgttattgctgaataatatcgcattgtatgggtattgtcacattttatttagccatggctatttaaactgaatgcagtaacattataaagtcagttcttctgtcacacaagcctcatttcacatgctcagtaggttcgtgtggctggagccaatatgtgtccatatcggacagtgcagacattaacacggccaccaatgcagaaagttctgccacacggcgcccttccagatcgcaagatcctgccataggctgcagcccaagtttcactcattcattcattcacctgacagcattattgagtgccagtgtacgtgggatacagcaggcagggaacaaaatgacaaaagtgtctgccctaatggaggcagcatgccaaggcagggacacagatgatccacagataagtaaaagagatggatgccaagaagggccatgaagaaccgtggaggggagggcgggccaggggtgacaagaggcaggaaggtgcagtgacaaaggggacagcccctgggaaagttgagcaaagacctgaagcaggggagggacggggcctgagatctcaagcgcctgtcaccccgggtcggagacgggccaggcacccagtccccactgtcccttgcctcctcgcccgtgttgcagatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgtaagtgtgtcatcccccagggacccagggaggcccctgggcccagctcagggcttcaaccatgcagcccaaacccaagcccaccctgggtggcacacagttttcgcagatgtaccccagggccagcggaaagcaattatgtcatgcatgttatatccctctgctggggaaggagaggccgggagctgttagcacctgtggaaacaggtgtggtggggccgtatgccaggaaatccagggagctgggctgtatacgtgtgtgcgcgcacatgcatgtcaccagcgggtgggaatggtgcttggatttctgttctgggctgggcagtctttgagcctggaggttgtcagggaggaaccccggaccacagcacaggcagctggttgtcagctgggatcagctgagccaactctgggcagcagcacaaagggaaatgctcttccctcccatccttcctggaggaccacgtgggccgcagccctcagccagccattctcctcgggctaacctttgagttgacatgttctggcagcgaacatgctgcgtctggggcaggggagcggacaggccactgttcccggcagcagcttccttggatcggctgggatattatggaggctggctcaaatgaggtttttgaaaagcagatgtgttgctattaagactgtcatttggtctgccttctgctcatgcccagatgtgggaacacacacccagcactcacacagggctggctgcggaattcctcctgaaaaggcgttgacagtgcagtgtggaattccagactgacatgttcccactgccttggacattttgcgagaattccaggaggcaggctgcatgagttcaaggccagagaaagtgatgactgactgttgaccttatcagatcacgcccgtctttggctcttagcgtccccattggactaagagctgtaataacgacagtccacacgtatggagtgtctactcttcagggcctggtctaagaactacataataattcattgcaagccgggccctgtggctcatgcctgtaatcccagcactttgggaggcccaggtgggcagatcatttgaggtcaggagttcaagaccagcctggccaacatggtgaaaccctgcctctactaaaaatacaaagattagctggacatggtggcgtacacctgtaatcccagcactcaggaggctgaggcaggagaatcgcttgaacctgggaggtggaggttgcagtgagccgagatcatgccactgcactcgtctgggcgacacagtgagactccatctcaaaaacaattaataattcgtttcagcatcacaactgccctgtgacgtggatgctcatagtagccccattttacacccaaggccactgaggcacggagaggttaagttgcctgagtttacagcaagtaagggaaggggctggggcttgaaaccaggcagtctctattcccatctgccacgcctctcagaaacttcaaaccatccctgtgaacagaaagaatctgacccactgagggctctacaaacactgacattgggggtttggtcagcctcggaatctgtgatctgactcatagggcccaaaaccacatcccacatggtcaagaaaaagagagtgctcatgtcaggtttgggaccaaagacacacggtatctgtcagccaggactcctttggttgcaagcagaaatgacctttgaaccagataaggcatgtaagataaaaggaacacagtaactatagttactgaaaagtccatgcacagctccagcctcaggcatggctggatccagcagtcttacaatgccattggaaagctctcatttcttatctctcagtcccacttccgccgaattggcttcattctcaggtgggtttttctccttgtggcagggtcagcagctccagattttcagccatcctgtttaggaagccaaactgctttgaacagaagacctgaggctgactcccactggcctgacttaggtcacgtgtccttccctgaaccattcactgtagccagaggtgacagaaacccttgagtaaccaggctgagtacattgggcaggggactctgaatggggccaggtagttcctacagaattagaagctgtgacacagagcaaggcattggtgctggccaggaaaagcaaccactgtcctccttcccctgagcctgggggagcgggaccactggacaagctcagccccattagctgccggttgctgggttctgcagagcgcccgtcgctcagcagtcttcccagctccctcgcctctggattcagttgtagcgcctcacgctggccttcgagccccccatgacacagccccatcttcagcagctgcacacatgcttggcagcctgcccgacgttcacagggcactggactggggagagatgaggggttaaagatgacggaaaccctaggacccaggccctgccctggtccccagggaactagcggggaaggcactcagatgctctgacgggactgtccaccattcaacaggtcctgggtcctgtgctgggcacaccccttaagtcccttaccctacattgggaatgccatcagccagaaacaagagccaggagaggtggctcatgcctgtaatcccagcactttgggaggctgaggcggatgtatcacctgaggtcaggagttcaagagtagcctggccaacatggtgaaaccccacctctactaaaagtacaaaaattatgggtgtgatggcgcatgcctgtaatcccagctactcgggaggctgaggcatgagaatcgcttgaacccaggaggtggaggttgcagtgagccaggatcatgccaccacactgcatcctgggtgacagagcaagacacctctcaaaaaaagaaacaggagccaggaaaggtggcagatgtatgggaattcacttagccaatatttactgagtagctcctctgtgttctaagggtataagtcctggagatacagaagtgaccacctgagccagccttcctgcagcttagagtctaactgggcaatagacaataagccagagaaataagtaaattatatagcatatgagatggtgataagtcttcaggagaaagataaagcagggagggtggggagggggcgcagttccgaatagggtcctcaggaggggccttgtgttgggtatctgtgctgcagaacaaactgccacaaactcagcagcttaagacaacacacatgtacaaactcacagtgtctgagggtcagaagcctgggcctagccctgcagggtcgtctgcttaggctgaaatcaaggtgccggccagggctgtggtctcatccagaggcttgactggggagcatctgcgtccctgctcatggggcaggtcaagtgcaagcagaggacttgaacccatgcagtctgcctcccagactgctcacagtctagctgctgatttagagtggcttgcttcttcaaagccagcaaggggagaaagaaaccagagccagactgctagcaggatagtagttgactatctcataacacaaccacgggagtgacagcccatcaccttcacaacccactggttggcagcaggtgcaggttggtccacacccaaggtgagggggtcacattaaggtgtgatcaccagggacagggattctggggaccactgaggcctgtcacgggcctccttggtcatagagcaaagaactaaaggggtgagggacggtggcccctgatctccagggaaaggacattccaggcagagaggatggtaaagaagaaggccctgaggctgcactgtgcctgggctgtcaaggaacagcgaggagccagtgtctgccccagaggttcaggggaagggttcaggaagggccaggatttgggctggctgtaaagggggggtcgccttcactcaggaagtggggacaggaagggcaggagggggacagggtgaggctgtcagctcacggcatgagctgagacacagaaactaagggggggcgagcacagagtgggggttcagctgaatctgggccgcagaggggagctgctgaggttgaggtgccagactgcagcttccatacctgcagatgtcagcctcccacaaactgctgcccacctaccgctccccaccccccacgcgaggctgaggcaccaccacctgagtgactgagtccccgatctcctgcctcccccaggaatccccacatcgtcctcaacattgacctggcccccaccatcctggacattgcaggcctggacatacctgcggatatggacgggaaatccatcctcaagctgctggacacggagcggccggtgaatcggtgaggacggagcagggcaggtgttgagggggccgggacattgacctgcgggaactcagagcaaaaccctgtgggtctagaacgtggggtctccaagggtcgggagctggggttctcaggtcccgccatgccaaccacttacctgctgtgggagagaagcatggtcccctctccgagattctgtcttcccatctggaatgtggccaaggtgaccagttggggaccttctctgagctaaaattacccaaagcttgaaatgatagcagcagtgatggtaggagatggtgctaactgcacggcgcttgtgtgtgaggccctattctaagtactgtgcagggaaatctaggaatttgatcctcacagtaacccagcgaggtggacattatcatcatccccattttaccagtttggaatctgaatcccaaagcgattgagtgacgtgtcggaggtatcccagcaagtctggatgtagctctgggaattcagatgctgactcaccacgccccataactttaatgctggagggtgtgatgggaacatattcctaggtgtccagagaggcagaataggaaccgtgagggtgagcaagtcagacaggtgggaggtgggctgagtcagggcggggaggctggtgtggccgcagcgacatctggtggccagcgctcttaacagccaccaggttcctggcctccaggtgctacttcaactcctggcttgcacctctggcagcggagcccttcccctgtggcctcccagaggctccagccaggcgagcactgtgtgcccacatctggctgccctgtagggggaccgtgtccattgaggctcctcccctgactgtgaggccaggcaagctgtaatggtataaaatggacatgtttggggacactggcctgggagccaggacacctgggggtcaggggacagggtggaagcttcccctctcagcttcagagtccccatctaggaaatggaaatgaccaggtggcactggatgaaacatacaaattacatacatgcaactgcaaagcaccaaagaagaaaatactcccaaaacccaatgcaattaacctgacatcaaggcaaccactgcgcctgacactgagctcaagacagagctcaagacgccaaaccactgcgcctgatgctgaaccactgcgcctgacgctgaactcgagatagagctcgtctagtgccgggggagttgctgggcttcctgggaggggcttgagatgtgtgtgcgcgcacacacacacacacacacacacacacacagttacttgggtgggacttacagtgattttgacctgggtcatttctactgtgtgtgtctccagacccaagtctctggggaaggggtggctcaactcagaggagggtgggcaatgctctagtgcccagctgggcacactcaccacaattgctgtccaggctgaccgtaaaccaaggctgactcctggtgccgtccctgctcctgggggaacggggggtcgtgggaagccctcatgttgctgagaagcaggagccgtgcttttttccaggtttcacttgaaaaagaagatgagggtctggcgggactccttcttggtggagagagggtgagtgccgggtcctgggagggacacccctgcccacctccctccctctgcccaggaagcttctgtagccccaccgcatcatgctattcaggagctgcccatggctctgaagttggtccaaaggcccctaaacacaaagcccattcactgctcctatagacacagaattggggtctgaggtcacgtgtacgcttttggcatgctttgtccagcctctacaatgtcttcaatttatttaatttattgccaactcatgcaatttgggaagtttcttataaaattccaatgtcttaagtttcctaaacatcagaagacccgggcaggtggccctgcgccctccactgtgaggaaaagccggagccgagggggcacccctctaggtgggcacacatgcctccggggctcctccagagctgagaggccggccccgcggctcctgctctctgccccatagcaagctgctacacaagagagacaatgacaaggtggacgcccaggaggagaactttctgcccaagtaccagcgtgtgaaggacctgtgtcagcgtgctgagtaccagacggcgtgtgagcagctgggacaggtaagaaggctcccttccctcccaacggctccccctcctgactgcagccggccctgacctgcgaggctctgagagccgctgagccagcagggccagggcctcccaacgggtagtcctttgctgccgtgtggtgcccaagatgctgtttggtggtgcaggatgatgctcacaataagtgattcatttctcagcagcctttggaccctgaccgtgtcagaggccaagtgtcccgtgggtgtgtgtatgcccttagcgcctctctagcccttgccgatctctcttgcacgaaggccccagcaggagttaaattattttattttcaccatattcactttgacagtatcctctttgtgactggttttccttttataggagtaataagacatggctttttaaaataaatataggtaaggttttaaaaagtgaattgattgcaagagaaatattaaggaaattatggccaggaacagtccgtggctcatgcctgaggtcccagctactccagagctgaggcgggaggatggcttgagcccacgtgttggaggctgcagtgagctatgattgcgccactgcactccagcttgggtgacagaataagaccctgtctctaaaaacataagaaaaaagaaaattatctgggaagtatcagagatagccagaaactgacatgtttgggaaagcctgaaggaggcttttctgaggctggaaagccagggcaggcttggagaggagggtcgggggcggggcagggcagggaggggagtgggatggaaactctgccttggctggcccaaggggtgccggaggtgtgtccctgccctgcctgtcaaaggctgggactttgagctggggctggagctgtgtgcctgtttcacctatgagaaaaagcaaaaccagggccctggtattgaaggccaaggcctgaagtggatgcgtttctgatggactgcatttgaatgactccatcttaacactgcacacagaattagtacaggcccatacaggcctgactgtgcctccccacccagtgtgtgtttgtaaacccacagacccctcttagtcacacaattaacccgtatctgccaccgggcaggagctgtggatttcatccctccgttgtacagcatgaatgcgtccccccgcttgccaggcactgtcctaggcgcagggccacagcctcgaacatgctcaacagaagctcctgccctcccagagctgatgttctggagagagttcagccttgactttgtaccgagatcccagaagtggttctgattttagttctgggctaaaaggagtgaaatgaggaggccaggaagtctttgcccctcgacgagggaacgttgtcaagtcccccactggttctttctgatgtctcccctgacccagatcagggcttgggcagccagaatgacctctttgctggggccaagaaagaggaggtatcagcattttccaaacaatcagagcacaccactgaagccaaaggaagagagtgctgagggcggagtttggggcacttagcctaggccagctgggaggcagcaacccacggcccccgacccagccccggagctttggggacctcaggctcagacgtctgccccccatcccaggcaacggccctgctcacaagccggtactccccgagtgccgttgccatgtccctgcttgtgccgtgccttctggaatgccctgcccagtgtagaagctgtaccctgtggcccgaggacgtctcttaggggcctcacacccagccatagcattgtcttgggtaccttgtccgtgctaccccacgtggtagatgtttttttgtcatttgctgaacaaacgtgcccaggaaccgagctcatgtgcatctgtctgtctcccggtgacacggggacatcctaagggcagggcccggctagaattcatgtcatcattgccaaagcccagaccagggcccaggccgggcaggagtaaatgtgccctgggcacctcgtaatgatgatcatcacgggcaacacgtgagtgtaagctctacctccagccaccctatctggcaggtatgttctgtacacggggaaactgaggcccagggctcaggcaaactgcccacagcctcacagcttcaagtggtggaggcaggatttgaacccaggtagttgggctgcgggaccttcgttctcagcagctgtagggaccccaagtcaagccgacactggcccagccctgtggggctcaggcgccgcccccgccaggacagcctcgggacgggccatgtggacacggcttctacatgagtagttgcaggggcagcaaaccctttccgcacaagatcagacagtaaatagtttgggctttgcaggccacatatttgtttttgttcttgctttttacaactctgaaaacgtacaatgtaaaaaccgtccttggtttgcaggccatacaaaaacaggctgtgggctggagttgactagcaagagggctgctgtttgccgacccctcaagtcgtgccccagctgagtttgttgggttggagcggggagcaggcagtggggaaggagaattccaggcagagagagctaagtggacaggaggctgctcgccagcgcacacagctcagggcttcacgcagaactcagagccctggcttttcttgaaaaatcagacctgggcttctgggcctgtgctcccctctggcgacagtcagatgggtatagccggtcacagtgcccactttagcctccccaggtcccccaggcgcttctgggctggcctcattcagggccatgcctgctggcccatcagtctacttctgcactaaggaatccaggttgctggaagggcctgcatgcattgaaggggatgggagggtggcagggcgctgtgaatgcaattagattcagcctccaggtgagaacagatgggcgggacaggggcaagatgagcaggtgaaaggcaccagggccttcaacggcagcgggcgggggcagacggtgcagcagagggttgggggggatggtggcaccagactccacacttttccttacagctcttgcacctcccagttgtgtgacccaggacacatctctctacctccgtgtgcctcatcttgaatcggcacagtaatgacagcacctgcctcgtagggtagcgtgaggtgtagtaagcaagttaatatattaacacacagtgcttggcacatgctaagtgctggagagacacagggaacagatctgacccatggcctggaaaggtcactttggcacagaataggccctaaagagtcactgggtcaatgggctggagcagctgtggacagaagggaagagaatccagtttacaggtggttgcagaatcccgtgaggggatccaggaggctggaactggggaagagcagaaggatcaacacgagagatttggacagtgattctatctacattcagcgtctgaccacaggcctggagttgagtgcacacgtggagcctctgcacacactgcactgattgagtctgggaaggtggtcaggggagacctccttgcgctggagcagacgggaaggaagagaagcctccagcagcaggaagggctggagaaaaggcattctaggcagaaggaacagtgagcgccaagtccctggggcagcagcccacaggggatactggagagagggctgagggagaggaggaccgatgggtaggccagggccagattgcagaggatgttcaaagactagtatcaggagcttgggtcttgtcttaaagacagtgggagccattgaagggttttaagtaggagagtaatatgatccaacttgccctttaaaaagattcctctagctgccatgtgggtggattttaggagcagacagaagcaggtaaccgtgagagtggtggctgtcggaggcatctcgctgggggatgatggtagctctgcccaaggttcaagcagtggcagtggagagaagcggcattggagatagcagaggtggggctcggtaacagctggatgcaagcagggagagggatgtctccagggtggatgggggtggcaggggagaggcgggtttaggggagcagatgagcagctggccgaggccctggcatgtctttcagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagagtaagtgtcacaacctggctgagtgggacaggaggagagagaccatgcctggggggccccattcattcactccgacagttccacagagactgtcactttgccaggtggtgatctaggggctggggacacagccacatctcctcacgagccacccattctagtggggagcagtagtaataaacagataaggccaggcgcaatggctcacgcctgtaatcccagtactttgggagtccgaggcaggcagatcacctgaggtcaggagctccagaccagcctggccaacatggtaaaaccccgtctaaaaatacaacaattagccagatgtggtggctcacgcttgtaatcccagctacttgggaggctgaggcatgagaatcgcttgaacccaggaggcagaggctgcagtgacccgagattgtgccactgcactccagcctgggcaacagagcgagatccatctcaaaaaaaaggaagaaacacacatacaaggttctgtattgattggctggtgaaaatgctaggaccagaggttcacaggaacccagctctgtgcttcccctaggagccatgtttcagcgttcaattagtcagtgtttgtggtgagtttatagaactaccctgggctgggcgcggtggctcacacctgtaatcccagcactttgagaggccgaggtggacagatcacttgaggtcaggagttcaagaccagcctggccaacatggtgaaaccccatctctactaaaaatacaaaaaattagttgggcgtgtggtgtggcagcagagtcgcttgaacccgggagcagaggttgcagatagctgagatcacgccattgtgctccagcctgggcgacagagtgagactcggtctcaaaaaaaataaaaaataaactaccctgaagaacaaaaatagactatagttgagtggggaaaagcctcactcagctgaagaagtgtctacaccttcacacctcattctcggcaagggccgaggagaggacagtcagacagaagccagggagcaggcgaagtggagagagggactcttctagacccagccagaaggctcagccgccaccctgggccatcgcttcaccattctgaggctcagctcccaccatcaaacaggaagaatggtccctgcatgactttaaaacaagaatgagcctgtgccctgaaaatgtgtggaggcgtcggggtccgccggctagaagtgtgccctccaaggctgggcagcttcccacgtagcccatttctctggcctaaggacagccaaagcctaatgagagattttaggtgttgtttttaaaaaaaattatggtgaaattcccataaaatttatcatcttaaccatttttaagtatccagtagtgtcaactatattcccactagtacgcaacctatctgctaaatgaactcttcatcttgcaaaactacaactgtccccattcaacgttatctccccattctcccaccccgctcccacccccaccccgttctcccaccccgctctcccaccctgctgtcaccccattctcccacccgttctcagcaaccactcttcttctctatgagcttgactgctttaggggcctcatgtaagtggaattgtacagtatttgtccttctgtggctggcttatttctcttcgcataatgttctccgggttcatccacatggtagcctgtgttggaatctccttcctgatcgggcacagtggctcacgcctgtaatcccagcatttcgggaggccaaggcaggcggattgcctgagctcagaagttcgagaccagtctggccaacaaggtgaaacccgtgtctactaaaaatacaaaaattagccaggcatggtggtgggcgcctgtagtccctgctactcaggaggctgaggcactagaatggcttgaacctgggagcgggaggttgcagtgaactgagatcatgccacttcactccagcctgggtgacagagcaagactgtctcaaaaaaaacaaaaagtctccattctttataagacggatgatattgtaccacagactagttagagattgaggtctctgacggcaggcgcagtgatctcctctggtccagccagccaggcagcaaatgtcttcatcgtggagcagataagtctctctccataacagcccagccactgcctgaaacaccgtttcccagctgatgaccctccgttacatttcctcaccagctgattaggaactactacattaacttttctagctgaacagaatgattggtttccagattggattacacagccagcatctccttgcttcaatatgtggcacagtcgataatctttaaataatacaagatctggcagggagaaattcagctcttttccccttattaatgcttagaggaaagaaaaatacctaaaagtagctgagagtcagctcagccctggtcagaatcctcatgtgagtgtaatgtcagagccgggacctgcacctctcaacagccctgtgagcagggcaggggtgatcatcaggggatgatggacaggaaagactgggtcacgtggctgatttggggactccagccccatctcctgcctggcattcttccccctgctagagtctccgacaagacactctgtccctcttttctgagcagtcagcctagagcaggctgaactgggggctttctgtcccccaggggacacttggcaatgtttggagacagttttggctgtcacaattgtgtgtgatggaggggtgctgctggcgtctagtgagcagaggctatggatgcggcaaaacatcttgcaacgcacaggacggcccccaccacagagtttgatctgaccccaaagtgtccgcagtggtaaggttgggaagccctggcccaccttgatccacggggatcctggctgtggcgtggggaggttaggcagagccagccagctcacagcagaagggggacccaggaacaggagaaggggacgaggactcgggggatgggcccagctgactggggttcattcatttcttgaactttgtgcaagacactgagattagagttgacctggagagacacggacttggacctcatggatgaaacaagatgtgaacaagtgaacaaagggccacttccgctggtgaaaaacgcatgaaggagacgcagcggtggcgggactagcagagaggggtggcggctccagaatggcgctcaatggacatttaatgagaacaaagtacagaaaggagcaggtcttgtgaccagccagagagcaagtgttctgaggaggaggaagatggagtacaaagaccctgtgctcagaatcagggcggtgagtcccagtcacagagaggtgaccggtgtggccgagggtggtgagaagcaccatgggcatgggcagccacatcacacaggcggtcaccggcgtggagaggcagggagtgggcccagggttgtcaccttaggtgaggacgtcagctgcaggcagagtccccaccccctgcagtagctggtccacaccagctcatcaggcatgaatgcttcactagttccgtttcgtgccatcctccaaggagcctttgtagggtaggcaccatcctgagaagttacccaaatcgccggggccacacatgtgctcaggggtttgcacctgagccatctgattgcagagtcaaagctcttggccgccgggttatgaagtcctgtcccattccctgttggtgtggcaggaagggtacctccaggactctggacatgaacacagagtgatggggagagcaggtagtgtggcttcagtccaggaaaggattcacacagggctggcataccgcttctgtgaagagccagagagtaaaggtcttgggctttgcaactcagccctgcgactgcagaggtataagggaatgcgagcagctgtacccagtgaaactgtattcacaaagacagatggaggctggcctgggcccttaggccatggtttagggacccctgaatctagagctgggagatggagggtggaaagaggcaaagcagctcacttatgagccgactgagacaaaaggagtggagaggacacgctgggtctatttcctgagcctctcggggcaggacctgcttggcacagggaccatcctcggcaatttgtgtacttgcatcgggagactaaaccgagggagagaagtgcccaggagaaggctgccctgtgtcagaaaaggcccaaggctctgctggagaggggaggcctttcccggcccctcaggatccttcggcccttgtgactctgatgcaaggtgtctgagaactgaaagatacaaaacatcccccaagagtgggggtggcacccgggccacgtgagaagggagccctttcctccctccttccactgccttccgccaccacctgcctccagctggtcctctttggtcaccatctcggggtcacttgggatccaacaaaacctgggtcactaactggctccaggcccttctctttaaatgaggcacatctggagaaggatgacaactgcagtgcgtgcctgctggggccagacatgtgtcaggtgggcagaggttttaaaacaggaaggagtggcgggggctgtggccaacagggaagacagtgggcagccaaaggggccgcccatccccggcccgtcctgaccatatggaactgtgggcccgtgagacatctgtttcctttctggaagctggaaatctggatccctacatcaccgccaccacctcccctttttctttaatgttaccaactcagatttgtttttgagacatagaagatacaggctacctggggtgtcacttcagcctgcacccctgagttttcagcgtcagggcgtatgcaaaagcccccctcagccttgttgccggcccacctgggtgtagcacctgcctaccacctggtgggcagcctccagctctctgggactcaaagaagctaagtggcttccccagtccccgtccatttctacccagagacaggcactgcagggcccctttttcccagtttaaatcaacatttttacatccatgatactttttttcctttttaattgaggtgaagttcagataacatcaaactcaccatttttacaattatatacaatgcagaggcatttaataggttcacagtgttgcacacctctacctagttccaaaacatttcatcaccccaaaagggaaccccgtacccacaaagcagtcactcctcactaccctctcccccagcccctggcaatcaccaatcttctttctgccgctatagatttacctattctgggtagttcctataaatagaatgtaacaatacgagcccgctttgtgtctggctggtttcactccgcctgcttttgacattcatccacgctctagcgtgaatcagaacctcgctcctggttctggtcgcatattccgttgtacagatgatgtaccgccatttgtttacccgcaagcagctctcgcttgaaatcctcttgagtcagtggcttcttggctccaggacttccgtcttgccggtgtgatcacctcgaggccctcccctgcggtccaggatctgcgagcaggcgggtagattccacgacccctcgagtcgcaggcaaagctgagcctcatgcttggaagcccggccctatcttgatgaaggacccactgccctgggagcctggccagcctttcctgcctccctaactctgccactcctctaatgcccacagagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgagtgtccaggtggaagtcgagggtgaaggggacaggacagacctcggcaaagggcttcccacacctcttgggcccctgaggaccaagatgacaaggatggtggggacttcagtggcactggaggccttcccgactattcagccgccaaccccattaaagtgacacatcggtgagtgtccaggtggaagtcgagggtgaaggggacaggacagacctcggcaagggcttcccacacctcttgggcacctgggctgctccccctccaccacctccgagccacacgtgatcccttctctcaagcaggtgctacatcctagagaacgacacagtccagtgtgacctggacctgtacaagtccctgcaggcctggaaagaccacaagctgcacatcgaccacgaggtgagtggagagcgggagaggagcatgctctcggccaccacgggcctggcaggacccccggttcacagtgggagggcagtgaggccagacccagggaagaggctggagaggtgaagtgaggtccccacagattcctcaacgcggggataggtgtcagtcccagcatgagacagatagcttcctgcccaggccgtctgagggacgatggcttagccacgttgtcccccttttgacttacaagaagtctacgctacaggaggcctttcatcaaacccaggggagacactggaggcctcagtgggctcagcgggttcctgcgcaggccaggccggaaaaatgactcggttcccttgcaagggctggctggaggagaaggcgggcttccttcaggcagaacaagtacctcctccccacccagacatgccggtgcttgccctggggcccggggagtgcaggctgccgctgctgagcacagacacggcagcgtgggggcagtcaccaggccaagtctttgttgtccagccttgaaggtttcaaggcctcctcttctgcccctccctcagattgaaaccctgcagaacaaaattaagaacctgagggaagtccgaggtcacctgaagaaaaagcggccagaagaatgtgactgtcacaaaatcaggtgaggcagtagcaaagggacctccctaagaccccactctcctacaggacagttcagttcatcccctctcgtgattgacccctttcattttttatttttatctttatcttctcccctcatggcattaaaaaaatccgtaatttacctccctgttgtcagccagtgtggcacacggacctgctcctcagccaggctggcgcccagattccagtactgctagcaagagacccgtgctggctgcgcagagccggctccaggccggaaaagtgcctctgccgattgccctttcagaaatcccccatgtggtttgaggtccatgttcccggcttaggggtcccctggcccaaaggactgaactctagaacagctctaatagaacattctgtgctgacggaaatgggctatatctgcactacaccacacgtggctggtgcatacttaaaattttggctagtgtcactaaggagccaaattttttattttgcttaattcaaattgaagtagccacctgtggccagtggctaccatactggacagcacagctgtagaagccctgctgtctttccagaaagtgttgcaaaacacaggcttccctgtgttgaccccgaccaagtgtgagtaggcagggtggtgagggaaccaacctcaagatgctgaggctttgacatgtaaaattaaccatcaaaaaagaaaggaaaaaggatgctgaggctgatgcacctaaagccaggcccagcttctagtcgtggctaaattacaattaacccaacctgctaaagtctagcaaaagtccaggcagagtcctggctcatgcttggagaaagaagccactcaggcaggcacctgctgccctgaggatagggtcatgccctacccaccaccaccccagaaggagggacaggggtggggcagcagcaacacatgggagtcccagaaatcacagcttgcacctgccagcggagccctctgagccactcctgaagcctggggctgggggggtctgttacagctaccacacccagcacaaaggccgcctcaagcacagaggctccagtctgcatcctttcaggtaagagcagcttgaggtcctggggaagagatgcagaggcctgcatgaggaggtggccctcccttaagctaaaactcagaagaaaaggaaagaagtccaggcccttccctgggaagtccacggtagccctcgaagaggccttacttcccaatcaacactgagcgggcctccgacgcccccttgtggctaaatggggttaccgcaactccaccaagcagggcaggacacaggaaggaggggaaaggggtgtcaacaggagtcccagtagctgcctggttctgtccccagcttgtgcccccttgggagttaaagtagaatgacaagacccaggttctggtcccggctctgccttggagcagcactgggacttgggaccctgaattgctatgcccatggctctctgttggagaagcctcagcgaagcccttaggtggacaggaagagcagagacatggggtcactgatccctcagaggcccaaggtgtgtgtggccctctgcgcccataggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacacgtgagcaagcccagggcaggggtggacaggctgaggcccaggggttcaagaaacttctccacttagtgacccagacctctctcagaaagggggtccccaacaccaggggtccacggtgctcgggacagcctcttggcatttgacgaactggttttaggggctgtccctgacaggaatcactgttggcagatggggcctcctcccgcaggcactcaggacatgctctctcttccttggcagtggggcctttctgtgcctgcaccagcgccaacaataacacgtactggtgcatgaggaccatcaatgagactcacaatttcctcttctgtgaatttgcaactggcttcctagagtactttgatctcaacacagacccctaccaggtacaggcaacccgagctagagggatgggggtgtggggtacaccagtgctgccaggtaggccccccccaacctcagggaagtgatgacaaattgtccaagtcccactgagtccctgagccggtgggagtaagttgtgaagctgctgagattgggggttctgtgttcaatcagccttttttgcctccatcaccctgctttttgcctccatcaccctgcgtgtgtaatatatatggcttcttccctctaacttaacatgcagcatgcaaccaggttttgccggaacttgtgaagactcctaacactgtcaggctgtaggatcaagccaaatatcacccactgcagggcctacacggaccgcgcagctaatataacagtaacacactgcaccaagcactctgctaagtgcttccgtacagtaagccatctaaacacacatgcgactgaagtggcccaggaccacacaagaccaaaaggagcagtggcatgtctggtcatcggaacatgtgggcccttgtacagggacagtcactactgagctccagcactagagctttcctgtactgtggccttggtattgcccaggctttgacctttcaagaaaagcctgaaataatttaaatgaaatctgatgtttaaatgtcagcagcacaaatgctttaattactatataggtgtgcagtctttctccttagataggttcaccctcatactttaccaaaggggtaggttaagtccctcaccggtagctcccagactacacaagaacccaggccacttacccgtcctttcatcaaatggctgctttgcaatcaggaggagctgagggcccctgaatgaaggctgctgataaaaccaagacttggaaggctttctttccaagcttgggaagtttcctgaccagtggctgcagaactccaacgttaaatacacagacgtggtttttattctcctgagttttcactctcatgaagagtgaacctggtgggacttgaagccaaaaagtcacctaactcttccaaacgctggctcttgcagaagttggagtaaacaggtcaccagcccctagcaccttccacccgccacctgcctgaaatatgtcccctggttggtagaagggcagggcgagagtccctgtacttaccttgttgacagactaccttttttgcaaccagctgatgaatgcagtgaacacactggacagggatgtcctcaaccagctacacgtacagctcatggagctgaggagctgcaagggttacaagcagtgtaacccccggactcgaaacatggacctgggtgagtaggcaccccaacgtggggcccttggacagcagggtaaccaaaggaagggactcaggaggtggtgtctaccccaagaatgagcctgaaatcaccaggctttgggaggtgatacagttccagacgagtcatgggagcccctgtccatagcaggcagatgacctttaacaagctgtgattcctgagagaggaacacctgcaccaactgcccaggaaacacacggaattccgtctcatttcattgtcctcccttttgtccactcatgcattcaacaaacacttcctgagaacttacacctgaaaccatgttgactaaagatgaccccatcctcgctgacttgtgtggagccagtgttgtcctaagaagagcagtccacagcaggaggcctcttgcttgtatggaaagggtaaaactggatggtagaatccagtgtgactggggaagggcactgctaaataaaaccagggtcagacctctgaactgagtcctgaaaagtaggatgcaatcgaccactgagaaaacgtggagggctggcgctccaggaagcttaaagtgtgaggagcagaaagcagctcagggggtgcagccaacacaactgaggccagtggagagtggcgggagggcatcgggccaccctgtgtggggcttcctaggccacggtagagtttagatttcatttgtggtgtatcaggaagccaatggagggttttaacctgggcaccgacatttgctaggtggagaatgggactttatgggagaaaacagcgaagatggcccagttatccagggagaaatggtggtggcttggactagaggtgggagcagtaaagatgatggatttcagattcaggtggtgaagcccccagacaacatggtgatgggaggtgcgggattaggagtcccaggtaaatcctgagttttgtttgggacaggacaaaatctgcagttttaagtttagaatgccaaccagatagatattttaagatgaaaaaagctaaacaggcatggttgctcatgcctatgattccagggctttggaaggctgaggtgggaggagacttgagcccaggagttcaaggttacagtgagctatgatagcaccactgcactccagcctgggagacagagctgtcgccccatctctaaaaataaaaaaaatatattaaaaaaagaaaacaaagctaaaagaaaaatgaagttcacttactagtgagagagagtggcctaaaaaaaacctttggtatttaaggtcccttggggaagggactgtgtctaggaggatgcctagagttcatgtcaggaaaatggctacacagcttaggaggaattcagacgctaccgtcggctctagttatgaagagggaagagctaatgtgtttacacaagatgttgcactaatacttctggtcaggagcctgatatgatcagaattttcactagtagcttcctaatctctgccactcaagtgctgctactcttgtgatcaaagtgcaatgacatattagtcactgtgtgccaggctctgtgctgagcattttacatgtgttagctgataagctttgaggtgaatcttatcctcattttatggaggagtaaggtgaacaaggtgggctgaccccggagcccacgcacttgatcctgccacatcctcgggaaaacttccccagagcccaaaggggaactccctcctgcacttggtcagggctcttggctttctgtcctctggagcacagatgttcatgcctgcatctacctccctcaccataactaaggtcagcgctgaatgaagccatcagggtcctgaaactgatcatggtgacactggattttaggcaatctacaaggctatctaggagacttagggcaggttcccctcataattcagtctacccctcataattcagtctactctgagtagggaacactatcagcatcatgggattgtgacaaaaaagcataagatggttttctggtgtgttggggttgttttgcctaaactatctgctcctgttttgtttttcatttctccttcatttaggacttaaagatggaggaagctatgagcaatacaggtatttcgttttattattaaagcctaaacaaagttctcctatcttggcccatccttcagtctcatctctgtgagtctgcacctgttatcttgagaaactgcccttccctctggtctgcccgagaccaggatcacccaccaaagataggtgtcacctaggagaccttctttgtatagttctttggggactttttctttcttggtgatggttaacattcattctcctttgacacttgaaaacttaggcagtttcagcgtcgaaagtggccagaaatgaagagaccttcttccaaatcactgtgagttgaggaaccagcttacaaatagaaatctggttctgaccgcttcattttgccaatgctattctatttgcatgccatttcttacataccaccctttgtttgttctcatgatgagggtgggggggaagtactaatgcacatctttccctaagaaaacacttgaatccatttcatgttttagattaatgccttgtccagtacactgctgttctcgctataatctgtgcttggtaaacttgagctattacttagaggttgagaagcatttaaatattacaaattgctaggcatcttgaaggctgtggctacaaaagtgctaactgatatacaacatcagtagtaggatggcctcattaaatggtttccaaaaagcccatgctacaaactctcactccagtgccattggaggctgacagggactaagagactggcaacctgtaaagttcacctctattctaaagggagcaggccagtttgctccctgcaggaatgggctgaggttcgccagattttctcattcgtctaccaaatccaaaaatgcaagtatgtgtgagaattctttatcattatcatctaatttgacattaagttaaccatgtgggcaaattatcgcccttggtgaactgccacttgcaacctctggtctactcatttcttcctttatatgcatataaacctgtgtggctttaataggacattagtaacaggtcacctaagcctttcttcggtgcttctagaattaaggtacagaatctttacatatcacaatctccttagccactattctgtccagatccttaaatgccatccttgccaggcattgggtgtataagtaaacaaaaaattgaggtgactaggtggtggcaatcccgttctaagtaacctagaaatattcattctcagcagccttgaagcaaagcttcctcagctataggaccgattaggaagtcatgataaagaccatgatagctaagtgctaagatgagtttgttttgttctttaggggacaactgtgggaaggctgggaaggttaagaaacaacagaggtggacctccaaaaacatagaggcatcacctgactgcacaggcaatgaaaaaccatgtgggtgatttccagcagacctgtggtattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggatttaaaaaaaaaaaaaaaaaaaaaaaactctttaggctccaattttaaatagaaacctttatttacaatgacatccaaaatggtcagcaaagcagtcacagctcaccatcccccataagtcatttcatgtggtttcaattctttgcaagataaagaataatttctatttttttaagcaacataatgtaaacttgattgaaactgaattcattctcaagagtataagtcaattcctgagaatttaaatattgctctcatattttattcttcgaaactccatatattagaaaggaagagagaaaacaccctgctcgtttattaacagtgtgccttggagttgaaaacaataaatcaatccttgaggttttgctcctaggaacctaattgtgaacaaaactcacagcttctgcaaataaaaagggaactgggcaggcatacatgtaactggcaatccattctgtttactttcagctgcacccacctctggatcaaagaacttctaggacatcaagccaattatcttctgtaataccctacccctaatatagatacccccaactcacctca

SEQ ID NO: 12 - DNA, 4313 bp, Homo sapiens
taacgctctttaagcaaacagagcctgccctataaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacaggtaaggcgtgcttcttcctgctctgtggggccacagccagctctggcagcctccgccaggagccactgttttacatacatatttttgagcacctgttttgtgccaggtgctgttctaggcccttaaaagtatatccaatttacaggatcggcaaaagcaggtggagagtaactcagggtggcagggcccccggagaccttcgagaagtgcgacgaggagggggctgccttcagtcggggctgttttcctgtgttaggaagactatacaatcctcccaagtgtcatgtttcaaagaggaagtgttggcgtggggtctcagaatagtgcttttgactgttcatgccaacatctcccccaggggcagaccctcccaaggcccatccagataggcccaaatgccggtcccagtgatggccacctgggagaccctctcccacaggcccgaatgcccgtcccagtggtggccaactgggagaccctctcctacaggttcctgggctcccctgggatccatgctctgggagtcaaagccacctctctcatgagtgcgtggctggcaacccatattccctggtgttgtcaagtggatcggttgccctgggtccttctagggagtggaggaggaggccattcttgcttccttgggaagtgtttgcatctcaactcctttacctgcagaatggatcaacggtctgccctagggctgtcaggaaatgctgtgtggcagcatctgcgacttgcactttgccagctgtggggagctgaataacttatttgccgttattaggtacagtttcaaggtgggggcaggagaaagggctttctacgtttccaaagcaagggtttccagagaggcctgaagagggagcgcccagtggtgctgtccgtgcccccactgccctccagccacctcttgatctctgctgtggggtaccgggcctgaggggtgggcttgggcagcgtagaagagcagccagcattgggctgcagtgggaagacccccaagcccatggcagggagcgggggagctttggaacccgagagaggaagtggcctcggtgtacagaacgaactgggtgggtccccgtgctggccacccccaggcccatctgcctgcgcccttgcccccaccccagcccccagctctgccccctgtgctgtgggatcacagaggccgtggcaaactcccctccccaccccacacaccctctggctcaaggctcagagcgtctttgcgggtcactcaggtccatgatcctgttacaactgaaatctagaaaattgtgattacagtttagtgcattcgtgtgtggaaaccatttccatttatttccatcatgcgacaaagacaaagcgggtgggcaagacagagtctgccggaggcagagcaccggggctggaaatcttcctccctgaggaggaaacccccccgacccccaggatgatgatcctccctcaccacggggcctctcttgacccccacagtgtcccgggggtgggcgatgatcaccttcacgtcgcgatggatccagaccccaggagggcaaggttcccatggaagctgctgggcagcgggagctgaacacggatccttcccagcaagccaggaacactttctccaaagacatctcgaggcagtccctgatagcaaagcagacaagagaacagcccctctcggcctcccctggggcgccctcacctgagccagtgtggccagactgagttcctcccctcctatgccccaaggcagggacagggaccggagggtgctctgggctcctctttcaccccctgctgcaggctgtcaaccaccagatcctaataggttgctttctgagacctttgattccgcggagctcagagcctgaagctctggtgttagaacctcttgcataagatcctgcggcagcccccagccagccccatctgtccacgtgtcttcctcctctagatccctttcctcactgccctgcttcaagctgtttcacagcttgtaccctctgtcggctcctcctagaccaccccacccggtcctctcaccttacctgcaatgggtttccacctcctgaacacacctgggtctctggaatggcctttgcccatgcggctccatcttcacctggtgaacctcctcctgcagggagcccccctgctttgttcaacctgcttgtcattggcctctccggggagtgccctacccccgtggttaccctgggcaccctgggacgatggccttgcgttgtctcgcacatgttcttgcctttctcctccatcagatccttagactcttttttttttttttttgagatggagtcttgctctgtcactcaggctggagtgcaatggtgcgatcttggctcactacaacctctgcctcctgggttcaagtgattctcctgcctcagcctcccaagtagctgggattacagacgtgtgccacaatgcccgcctaattttttgtatttttagtagagatggggcttcaccattttggtcaggctggtcttgaactcctgacctcaagtgattcacctccttcagcctcccaaagtgctgggattacaggcatgagcctgggcccagatatttagactcttattaatgacttctctggttttaatttctgggtctctctcacctggcacagtgcctggcttttgccatgctagctcccacttctcatgcacacaaatggtgctcagtaaatatttatgtattgagtaaaatttaataatcatttgttgaaattaaaaagtgaataaataagttacctagaaagatgcaaagtccacaaacctggggcaccttgcattttccctgagcgtaatgtttgcacatcaggatgtgaggaccacgtctccctctcatgtcctgagggttttatatccgcctcactggacagttgctgatgtcattggagaaggaagctggatgggtgtgtgcatgataacatcaaggaattcagcccacaacttactttgcttcttacctgtgcactttcagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaaggtatggcctttttatacgatgggttctgaagatttagaattagttagaaaagtcatttaagactacagaggctctgatcagcatcaccagctatgcctttacacagagtcacggccgccagtggtggtgcaatggggtagcctgagtcaggctgcattcaggtccaggaatagaaaggcagggctaagggacttgggaagaaacctgatttccccccggcttctcttcacatctctaaccaaaagcctgggaagagccactgttggtaacgctttctagcttgcctaggatagagggggaaggcatgacgaaatctgaagacatttcatgtattctttttttttttttttttttgaaatggagtctcgctccgttgcccctgagctggagtgcaatggtgcgatcttggctcactgcaatctctgcctcctgagttcaacctcagcttcctagtagctgagattacaggtgtgtgccactacgcccagctaaattttttttgtatttttagtatagacggggtttcaccatgttggccagaccggtcttgaactcttgacctcaggtgatctgcccgcctcagcctcccagagagctgggattacaggcgtgagccaccgtgcccggctgacagttcatgttttctaaagaatgtgcctatggatactttaaagtaaaaactctgtaattgtttaaatgtgaaagaaaatgtttatcctcactaaagcatctctttctccctccccctcacccctgtagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaa

SEQ ID NO: 13 - DNA, 31346 bp, Homo sapiens
gacttaacgcgcccccgccccgcgcccggcctcggcagccgcctgtcgccgcgggagcagccgctatctctgtgtgtccgcgtgtgcgcccggtccccgcctgccgcaccatggagagctaccacaagcctgaccagcagaagctgcaggccttgaaggacacggccaaccgcctacgtatcagctccatccaggccaccactgcggcgggctctgggtgagtgcgcggcgccggccggggacgcggctcgggcggggcggggggcgtctgcggcggccagagtcgccgcgggctctgggtcgcgctgcgagatgcctagacgaggaaggtggcccgggcgccgtcggagggcggagacgcgcgcctcgcagggccccgggctgcaggcggcttccgctgcgccgcacactcgccctacgcccgggctcggccgcgtgggcctctggtcctccgtgcgcctcaggccggctcttccccacgcggatcgccggccgcgcagctgcatggtggcgcgggggatgggctcgcgactcgccaagtaccctctagggtgatgccgggaaggccaccattactgctgttctacagaacgcggccctcttaaccctctccaccacctggctgtgtgggcgccgccgggagtgttcccccttccagatggggaaacggaggctccgagttagtcagctacccaaagttacacacagggagatctgatttgagccccagcagtccgactctagagaccctgtttttaattcctcttgcaggagactcgggggcccggccttctccccacctcagactacgctcccctacccctgtctcctgccacccctgggttgggtccgagtttggagcagggggctgctgagacgccaggcagcggcggggctgattgggggaagaggggaggagggcggtggcacgtgggtgcagaaccctgggatccattgtgaaaaggaggtctaagatttgacctggggcgggaggaggcggagggcaaggagactgagaaggctgagcgccggaaggacggagttccagggccctagcgccgggagtgacgtcctggggcagggccagccaccaggtgctgtatctcccaggcaggagctggcgtgcctaggccccaagatccttccctggccagcccttttggcccagaaggtggacacccaaggagcctcctctgtagcggagacagggataattaatgagggccaccgtgcatgcagctggaggtgtccagtggggtgggtgagggggtcagtcagtgaattacttcagagcctgcttcccgctctgtaaagcggggacagtaatggcacttaaccacgctgggtggtttcaaggactccagtgctctacttggaggctgctttgaggccacagtgccagcagtgctccgggctcatgacagggttgtgagggctgcgtgatggatgatttctcgggaccttcccaaacaagctctgtttcagacagacaagattctggcttctggccaatttcattcaggatatattattaagaagtaaatctgttcacctttctgggtggatacgcattcaccctttgtgcctctaagacaccctgttctcagaagggattagatgtctttcaaagcccttcccccacccactgccttgcacactttggacctgttagctctcctgggtttgtgtcagtcttaccacttatgtggggtatcccctgcctgggcagggacctggcttactctcagctcccctttcaccagcctggcacacggtagctctgcaggccttgtattgcttatttggtactgttggacctgctacctttggccgtttcagggggtctgaggtctagctggagagaggcagcaattacccaactaagtagtattgcacatctgagcatctttcagggctagataaaacatgcagatgtttacagggttcctgagctgccaagtaggtatctggtatgacacagcatcatcgtttgttgcatcctgagaataaccctgtgagatagattgtgttgtattcacattttatagacgggaacactgaggctagtgtgttaagttacttgcccaggctgggaattggtggccattccgtactgtctggttggggctcatgctgtcaggaatgcttcttggcagggcatggtggttcatgcctgtaatcacagcactttgggaggccaaggtgggaggattgcttgagcccaggagttccagaccaacctgggcaacacagtgagaccccatagcttaaaaaaaaaattttttttttgagatggagtcttgctctatcgcccaggctagagtgcagcagcacaatcttggctcactgcaacctctgcctcccaggttcaactgattctcctgccctagcctcctgagtagctgggactacaggcatccgccaccgcaccggctaatttttgtatttttagtagagatggggtttcaccatcttggccaggctggtctcttgacctcaggtgatccacccacctcggcctcccgaagtgctgggattacgagtgtgaaccactgcccccggccaaacattttttttaattggctaggtgtggtgatgtgtacctgtagtcccagctacatgggaggctgaggcagaggatcacttgagcccaggaagttgaggctgtagtgagccttgaacatgccacacactgcagcatgggtgacagagtgagactgtgtctcaaaagaaagaaagagagagagagagaaagaaagaaaggccaagaaaagaaaaatagttgggcatggtgttacatgtatgccagcactttgggaggccaaggcagaaggttcgcttgaggccaggagttcaagaccagcctgggtaacattagcaagaccctgtctccaaaaataaataatgtttcggccaggcgcagtgactcatccctttaatcccagcactttgggaggtgtaggcgagtggatcacctgaaggtcaggagatcgagaccagcttggccaacatggtgaaaccctgtccctactaaaaatacaaaaaattagctggacgtggtggcgggcgcctgtaatcccagctactcaggaggctgaggcaggagaatcacttgaacccgggaggcagaagttgcggtgagctgagattgcaccattgcactctggcctgggcaacaaaattgaaacttcttctcaaaaaaaaaaaagaatgcctcttgggcaagcagtctgtgccaggctggagaatggtgaaaaaggtgaaagggaaggccaggtacagccgcggtggatattagtcagtctgaaaggcacttggagagaaataagatttacaaatgtagggtgctccaaaagagtggaatgtcaagtgtgtctcctagttctttgttaggcaaagtctgatttcctcaccgccgttacccctccggaaacatactgtggtgtccgagagttacaccatgtttacattgtaatgtcttggagagggaagctcactgaactcaaaaaatatccatttgcaaaagaaaaaaaggatatgtaaaatacagtgactgtgtgtgtgtatgtatatgtttaaaatatgcaaaaaaggagggaaaacttatttttcagaaggaaataacgttgctatgcaacccatattttgaaagttgtgagccaagagtatgtgtgtgtttgcacccaaaagctaatcaaggaagacttgagacacaggtagtcttctgtttcttgtccccagatgtttatcttgaggcccactgttccctctctgcaatgaggcatagagtgaaggctcagtccggaagccctggcccaatctgggctgtagtcacagctaaagtgacagtttgtcagaatgtccccttttctgggggagctcacaggactttgatccagttctttttcttttgagatggagtttcactcttgttgcccaggctggagtgcaatggtgcgatcttggctcaccacaaactccgcctcccaggttcaagcaattctcctgcctcagcctcccaagtagctgggattacaggcatgcaccaccacgcccggctaattttgtatttttaccccgtagagacggggtttctccatgttgaggttggtcttgaactcctgacctcaggtgatccgcccgcctcggcctcccaaagtgctgggattataggcgtgagccaccgctcctggccccttttccttttttctttttttttaagacagggtcttgctgtgtcacccaccaggtctggagtacagaggcacagtcatggctccctgcagtcttgaactcctaggctatagcaatcctgcctcaccctcctgggtagctgggaccacagacatgtgctaccatgtctagctttggtccaatcttttgctggccacttactgagacaggatttgtacattctgtgaggacccaggctcgtttctcgatagctttcccattcctatgccattgctgacccgtgtgcagtgaacctcaccaggcccaggaagcagggacactggcctctgtcaggagttgggcctggaggtgaagggacagacctcacagaaggctctttgttgaggcagcgcccacagtggctagagcttctctggggtcatctccttccatgggctgaaggaattatggcaagggtccagctcatcctggctttaaaaaaacaaaaccccagtggccttgtcagaagtggcctggatgctgaggctggtggcaaagatttctcagttctcaccagggccagactgtggtgttatccaaacagtgcaagtgtcatctgaggactccatcacagtcaggcctgattcaaaagggaaggtggtctgtgctttcaacaagtccccccagggtttctgacccacagctttggggaggttaatgcctggccagtcctggctggtggacacaggagatgagtccaaccctggctctgttcctagtggctgtgcctttgtcagaaaggcccttccggccaggtgcggtggctcatgcctgtattcacagcactttgggaggccagggtgggaggattgcttgagcctgggagttcaggaccaaactgggcaacatagtgagacctcatctctacaaaaaaaagaaagagctgtgcatgtgcctgtagtcccagctacttgggaggctgaggtgtgaggatcacttgagcccaggagttcaaggctgcagtgagttatgatcatggctctgcactccagcctgggcaacagtgaaaccctggctcttaaaaaaacaaaacaaaacaaaaaaaccttcctatctcaggttctcagttgcccaggctagaatgctgtggcgtgatctctgctcactgcagcctccgcctcctgggctcaaatgatgccctcatctcagcctcacaagtagctgggaccacaggcatgagccactatgccttggctaatttttgtattttttgtagagttgaggttttgtcattttgcccaggctggtctcaaactcctgggcttaagcgatccacctgcctcagcttccctagagtactgggattacaggccattttctccatcttgaaaggagaggttcatggataggtggtttcaaactgggtgcctcaggagtagggctggggatggagtgagtgggctccggggtcccaccgcccgctgttgctgattttacatcctggtgctctttgtgcccttaaagtggctggggttgtatcccagtttacccagctctgacatccaggtgctttggctgaaggcttgagggcctcctggggtctctggccccatgtggctccgcctctctgggcctgtttctgtttttgggctgcctcaggacccatcctggccctgactgaggcaagagcatgaccgttgagattgccccagcagcagcatttcctcactcagtgtgaagacactggccaccctggggtggcttggttctctgcccgagtgacctctcctctgcagggctggtggtcggtgttttaagaaactggaagtgaagtacagcacctagttaggatctggctgagactttgtcgtggcttcctatggactctaactgatgtccggcccctgttgtggctctgacccctcaacattcattgtctcttgtggcaggcttgttgtcactgtcgcctagttccacaaaatcaggaactcccttcttgccacagaccagtttgccctgggtgctggggacacttctagaggtcagggacctgcacagagctaggtcctcaggcaggctctgctcctgccctgaatggagaggcaaggtaggggagagaggatgtgctgggagctggggtgagcccacctgcagatgggggttgctcagaagtcagttgcatttgtgcactgggtggaatctccgaggactacacagctggaagggaagtgtggacgcccaagaacttcctctactgagctctcctagcacctttttcttcatttatttgtttgtttgacagagtctcgctctgtcacccaggctggagtgcagtggggcggcgatcttggctcactgtaacctccacatcctaggttcaagcgattttctgcctcagtctcccaagtagctgggattacaggtgcatgccaccactgcccagctaatttttgcattttcagtagggatggggtttcaccatgttggccaggctggtcttgaattcctgacctcaggtgatcctcccgccagccttggcctcccaaagtgttgggattacaggcgtgagccactgctccaggccctttttcttttaaaaacaaatttttaggccaggtgtgatagctcacacctgtaatcccagcactttgggaggccaaggtgggtggatcatttgaggtcaggagttcgagacagcccagccaacatggtgaaaccctgtctctactaaaaaatacaaaaaaaatgagtcgggcatggtagcaggcacctgtaaccccagctactcgggaggctgaggcatgagaatcgcttgaacccgggaggcggaggttgcagtgagccaagattgtaccactgcactccagcctgggtgacagagtgagaacttgtctcaaataaataaataaataaaaataaaaacaaatttctagcagcttgattaaggtataattggcgtatcataacattgtaagtgattttaatgaatttgcagagatttactacaaaaatttaccacatctcctaaaagatctcttctggacatttgctgtcactccccatttccacccccagtcctgggcaaccactaatctaattttctgtctctaaatttaactcttctagacatttcatataaatgcaattatacagaatgagttcttttgggtctggcctcttagcataatttttagagggtcatccatgttgtaacatgaatcagtactttgttccttttttttggggggtggggggcagggtctccactgtgtcccgaagctggagtgcaatggcacagtcatggcacactgcagcctcaacctcccgggatcaagcagtcttcccagctcagcctcctaagtagctgggaggcactcaccaccatacacagctaattttaaaaattatttgtagagacagggtatgttgctgagcctggtctcaaattctgggctcaagtcctcttcctgccttggcctctcaaagtgctggaattaacaggcatgagccaccacgcccagcccttcatttctttttacggctgaatattccgttgtgtggacatagtgcattttgtttatccattcaccagtttttcttagcattttgctcttatcctagctctgctgctggcaggccgtgtgactttaggcaagtcactttctgtgaaccttagtggccccatcctccgaatgaagcatagtctaatatttactgagcaattgctaatttctatgcatggtgccacgttctgtacatacacactacatcatttagtcagattcttcttttacctccgttttatagtgaggaaactgaggctcaaagaggttacagccccaaggttactaggatacatcatgtattcatttgtgcactcagtttgtgcctggtactattcaagcctgtggatacaacagtgaaaggcccaaagctctgtcctcaaggagcttgtattgcagtagggtagacaggcaataaccacctaatgtcaggtggcaagcatgagtgaggggaagaagagctattttagacagtgtggtcagggagggcttcttggaagaggtgacatggggcagagatctgaagaaacaacctgaggtctggagccagaggttctttccgggcagaagccagctcgggtagttcagggcacaggaagagcaagaactgcttctgatgttcatttccaccctgacatcctgggattctctcctgagtattttttttttttttttttttttttgaggtggagtctgttgcctaggctggagtgcagtggtgcgatctcggctcactgcagcctctgcctcccaggttcaagcaattctcctgccttagcctcccatgtaaagtagctgggactagtggcccgcaccaccatgcccagctaatttttgtgtttttagtagaggcggggttttgccatgttggccaggccggtcttgaactcctgacctcaggtgcctcaggtgagccaccgcccctggcctcttctaaatttttttttttttttttttttgaggctgagtttcactcttgtctcccaggctggagtgcaatggtgagatctcagctcactgcaacctctgcctcccaggttcaagcgattctcctgcctcagtctcccaagtagctgggattacaggcacccaccaccatgcccaactaattattgtatttttagtagagacggggtttcaccttgttggccaagctggtctcagactcctgacctcaggtgatccacctgtctctgtctcccaaagtgctgggattataggcgtgagccacctgaatatttaaaaaaaaaaaagtatatgcataaagaagaagataaatgatgtactcttgtcataaataatgaacctgtgtgtagctgctcccaggattaagaactagtacattacagtgatttttggaactacagtgggtccctccatcctcatcttcccttcccctgagaaagaactataccctgaattttttgtttgttatcattctattgttttccttttttttttttttgagacggagttttgctcttgttgtccaggctggagtgcaatggcgccatctcggctcacttcaacctccgcctcccgggttcaaacgattctcctgtctcagcctcccgagtagctgggattacaggcatgtgccacatgcccggctaattttgtatttttagtagagatggggtttatccgtgttggtcaagctggtctcaaactcatgacctcaggtgatctgccctcctcggcctcccaaagtgctgggattacaggcttgagccaccgcacctggcctgttttccttgtagtatatacaaaaagacttgtacataaatcaatatggtcttctttgttaaacagatccttctgcactgtgcttttttcacactatatttgggagagaatattgataccggatttgtgaagtgtagctcgctcattcttactgctgtatagtatcccattatattaatatattccagttaacctcgtctattgataaacatataagtgagttccaggtcttgcaattgcaaacaatgcggggcagccctgtttgtgtttccttttttttgttgttgttgttgtttttttcctgagatggagtctcactctgtcaccgagtctagagtacaatggcacgatcttgattcactgcaacctcagcctcctgggttcaagtggttctcctgcctcagcttcccaagtagctgggattacgggtgcctgccaccatgcccagctaatttttgtatttgtagtagatacagggtttcaccatgttggccaggttggtctcgaactcctgacctcagttgatccacccacctcagcctcccagagtgctgggattacaggtgtgagccactgtgcccggcctgtttgtgtttcctgtagaatgtgtggaacatgtgagtacatttcactgtatgttcctactggtgaagttgctgggagttaagggatgtgcatcttcggctactgatctggtttatttttaatgcttgaaagattacttaggttctctatttcttcttgagtcagttttggtaaattattttcattattgttattattttttagacagagtctcactctgttgcccaggctggagtgcagtagcatgatctcggctcattgcaacccacgcctccggggttcaagctattctcctgcctcagcctcccaagtagctgggattataggcatgtgccaccacgcccggctaatttttgtatttttagtagagacggggtttcaccatgttggccaggctggtctttgagccgctgacctcaggtgatctgcctgccttggcctcccaaagtgctggaattacgggtgtgagctaccgcgcccaacctgacatccattatctcttgaaggagcccatctggagggtgagggagcctctctggccttttcttgcatagaaacctgtgagcaggtggagtgagcactaaagcgatgacagagattctcctggccaggggacatctggaagaatatatattgtcctggaggggagtggagagggggcttttttttttttttttttgagatggagtgttactcttgttgccaaggctggagtgcaatggtgcaatcttggctcactgcaacctctggctcccaggttcaagtgattctcctgcctcagcttcccgagtagctgggattacaggcgtccaccaccacacctggctaattttttggtatttttagtagagatggggttttaccatattggccaggctggtcttaaactcctgacctcaggtgatccgcctgccttgacctcccaaagtgctgggattacaggtgtgagccactgcccccagcctggagggggctttaagagactttctttgggcctagctctaagcttgccacaccaccgtcacaggttgaactaattggggttgtaagtggactgttttggtcaaggcagggtgtgttagttttttttttttttttttgaacagtcaagtgtgcttgttagccctgtttatcacagagtcagggtatacagtaagtaccctgtagcccctccaccgtgctcctcaccccatctctcgccagtgttcacccagagttgtcacacacagcaccacgggatggggcgtccacctgcagttgtgcaggcagtctggaatggcaggaaaaactctggccctgaggaggccacaggcttaaatgtatgcctttggccccaaaggcccgctaggaagttgagcttgaaagtaactgtctcctgtgtgctcagtgctttacagtgtgcagagcccggtctcaatccttggtgtatttctcccctcttgcctgcctgtggccagcaggagtgggtggtgtcaccatccctgcctgtagataagagctgcaggtgctgagagggttggcagtggtggcggctgctagagacctgggtactgtgcatgctgcgttatctcactgtgtctcccagacactctcccaagtgaagaagctgagccccgggttgacgaagcacttgttgaagtcacgaagcccaagtggcacagctcacctccccaacccaggatgctctgccgagggagagccccaaaagctctggggaagagtgcggggacacctggctcctaagcgttcttcttttgtgcgtgtttacttggtagaagtgaagagagtggccgcagcaggctggatgcagcctttggaaggaatgaaaggctgcaggcctagcaaggaaggcttaaaatcagctgcacgttctacttctcacccttggtcacctcgcagctgaccttcctctctccacgtttactctatctgggcctgggtgtgcttctgccacacacagaaagagcctgtgccacaccatttctccctggaaccccttctggtggccaatgggactgtcaccccggggtgtcgaggtggatggggcaggtggagccctgcacttaccgtccttgttcttccccggaacagtttggcccagtgtccacccacatccttctcccaccaaggatccctcctaatgggaccatggctttagaaacaggacccctcagggccggggctgcccttggaggtgggaaggacgagaggtcagcctgaggtgacctccagttgaagctggccctgggagcgtgggattagggtggcctccagttgaagctggcactgggagcgtgggattagggtccctgccaggcagaaaagggtttctcgtttaccatgtcctcccctccctctttcaggtgtagtgtcttttcccatgaccgggagttcatagaaatagttaagtataagatgatcgtgtgcgagaatgttggtactaaaccagcatggacagttttctggatttctctactactaacttgtctgcactgagcgtgactcacccctaacctggtgggagcgctgattggaggggcgggaggctggcggcgtgagctccagatggtgcatgtgcccttgggcttggcatgcggcgtgtcttcgtgtgaaggacctctgggagcagcgagagggctgagctgagctgagctgagctgcatgtggaggggccctcccgggaggcctgtgccctgaggctgaacttttaacaaaaccctgggaccagagggcttcagggctgatcaggacctgcagcgcttcctgctgggaagcaggaagcaatagaaagtttacgctttctattgctcaggagccgctcagtgattaaaacaagtctaaaaagccaaggggactccgtggccccaccactcccaggctggaaggcaggttcttgctttgtcagcccttcctcagcccttgtccataggcagaaggggtttttattaatacatgattgtagccttgtaggagatgagattatgtgtcttgctttgaaaattctacacaaaagcctgtttcctagttgctacagcagccctcaaactgcccatttctaaagctttcaagtagcccagtgatgcaattggaaagcccaaggcccagtttttcaggctaccacaccccatgcgtggaggctgctgggaggtctgtggtaactccatgagcctcagtcccttcctccctgccccatgggctcagaggcccagcacccctgggtgctgagagggcagggtgcccttcacaagtgggcagtgtccgggcagtcctgtcaggatgtggggtcagtcgtaggaatgccggcaccccttggctgctgagtccttagactcctgggggccactaggtgggaactgggttctacctgacagcagctgcccccagccgcagtgctagccttgggctgagtcttctgtgctagatctctcctgggcccctccttccttcttactcaagtccaaccccagatattttcagttgccgtgattctgaggatctgatgcccctggaaaggtacaacagtccccagcacccactagctggcccaggccccaaactgccaggagtggccttcttgagaccatgtgtcaccctcccagggaacaagagctcgtggctgtctgataagccaggcctgtgtgactcctcaggacatgcacccccaggtccctgtacagctgagcacaatagctcaggagtgcagggccatgatgcctgtgtctgtcttctctcctgggccacagccaccccacgtcatgctgcagcgccgcagagatcatggctgtcctctttttccacaccatgcgctacaagtcccaggacccccggaatccgcacaatgaccgctttgtgctctccaaggtaagagcccagctgcccactgccagccacaccttgcctgggactagggtcacacgggccctggaatggtgagtggtctttgaggagacctggctgggcccacctctcccaggtgccttctccctgctcgtcctggcctctccctcagtgtcctgctctgtgctgacccagctggctaaggaatacaggactgaattgatgggttgctctgccatggagcccaggtacataaacaacgctttaactcaaagaaatggagtaggggactacggaaacatctgttgtgtgttctgcccagtctgggtgttgacaggcaggactggcatctcggtctgggttgtggctccctacctgctctatctgtgttgtgccagcgctcccgaggccacggcttgccccctcggggtggtggtgtgctgtagcagggttttggatggggaccccctgaccccccccttctgggtggaatcacagccacagatccctgaaatccacctgtgctcaggcctgcctccgtggcgtttggtctctcgggcaggctttagagcttagaagtctgtccaagttgttcccatgccacaaaccagggattagggcagccggctgcctgctggggttttggcttcgtccagcctcacagctgtgccccctgcacctgtcttagtgcctgcctggccttggcagtgggaactttgggctgaaaaccaagaggctgaagagggctgaaaggggagaagtggccttcacttgcttcctcccctgaaatggatgctgcagttggccggctcggccgggccccaggggtcagtgtgaagtaggcacagcccgaagtagaaccgctccccacctgacctcaccccaccatccatctcccggcagggccatgcagctcccatcctctacgcggtctgggctgaagctggtttcctggccgaggcggagctgctgaacctgaggaagatcagctccgacttggacgggcacccggtcccggtaagtgctcctgccagagcctcccatgcctctgcctccacttcctatttcccagacatgtgggacgggggtagggggtgcccactgagaagccaaaggtgttgaaaggcggaggagggcattgagttgaggaaggaaagaagcaggtgttttggggacacgtattcaacccaagctggtgccaaaggggaaggccttctgaggcctcagccagggtgctctgggatgacttcagggagggcctctccccaagctacccttctgcactgggcctccttggctaggtagctacagcttgggaagagaggggactcgataagggagtggctgcaggatgctggcgaaaccctggggaagggacccagtttgttccttggggtgccatctggcatccctgcaaacgttaagacttcatggattaccacaaaaactgtcacatggtctgggtccccacgaggggcaaatgttctgtcaattttttcatgattctctctcccagcactttgtgaagtgggtgatgtgggaactgaggctcacagaggttcagtcccttgcctgaggcctgaggccacatagctggctagtgggcagggctgggatttgaacctataattataattagttcattaggagaagaagtcacatgctaggtagaggccatcctggggcctgaccttctgcagaggaagggcttgctgggctgggtgggagtgtggctccctaggcgggtgagaccaggatcccttctcctctcagattaacggtggccttctgttatgacagaaacaagctttcaccgacgtggccactggctccctgggccagggcctcggggccgcttgtgggatggcctacaccggcaaatacttcgacaaggccaggtaacacacctactccccacccccaacctgggtagttttggggagtggtccttgggtgacccacccttcaccatcgcccccagactcttcctctttcctggctagggcagagtaatacatatgcgtggcctcttttgctctttaaacatccgctatggctggtgccatgaccggccccctttacaaatgaggaaacactcaggagttaagggacctgccctgggtccctcagcagtgactggcagggccaggtttgcacagagtgcgtgctctcaatcatgtgctcttcagccagagtgcttaggctgaggacttcctgttttgcccccagccctgtgcccagaccccagaagtctcagaaagacccacccccaggcccctgtctgactaggcaccaggagcccaggcctgagccacttgcctttatcttggtaaaggggagggttgtatgttctgaggggttctgggatacctgtaagccacctcctatcagcagggaagaaacaaacatttgagagattgagccttcagagggtgggtgatgagcctgaccagaaaggtgtgctgctctagcgcccaccaggtgatttgtaggaacggccccccaggaaggttctagccataagtttgtctgcggtggtcagatatggcctggggggatgaggttgtaaactgttaagaataatggctggctgagggaaggattgcttgaggccaggagttccagaccagcctaggcaacagagcaagactctctctacaaaaaatacaaaacttagccaggcatggtggtacacacctgtagtcccagctacataggaggctgaggtgggaggatcacttgagcctagggcttcaagattatagctatacatgattgagccactgcaccctagcctgggctacagagcgagactctgcctctttaaaaaaaaaattattcttttttttaaagaataatcactgtattagtctgtttccacactgctgataaaggcatacccaagtctggggaagaaaaagaggtctaatggacttacagttccacatggctagggaggcctcacagtcatgctggaaggtaaggaggaacaagtcacatcttatgtggaaggcgcaggcaaagagagagtttgtgcagggaaactcccgtttttaaaaccatcagatcttgtgagacttattcaccatcacgagaacagcatggggaagacctgtccccatgattcagttatctcctgctgggcccctcccacaaccagtaggaattacgggagctacaaggtaagatttgggtggggacccagagcctaaccatgtcagtcactcatcagaagggttcctttgccctttgggggctaggccctgtgctcagtgctcatgtgctgtattgggttccacctttaaaagccccctgtgagttgggtagtggtgtgagaaccgtgacccgtcttacaggtgaggaagctgaggcaagatgctggcctaggccatccagttggtggtggaggtacccaggctgctcttggagaggctgagggcaccacaggagctcggggagtcctgtgggcgggaagcctcctagaggaggaaggccagtggggccagcccgcagggtgtgagaagggcccagttctgcagctgatggcatctccactgccctgtcctccactcctgcagcagaagtgccatagtggggttcgggaagactgtgggtccttgaaggacaggaggctgcagggagcaccttctgtgtgcaggcccttccccaggactggctctccaaggaggcctcacagtcccttccagaccccttcaggccagtgtcacctgaccacagtttgctttcattccttggtgagccttggggcaggcttggctacacccagaagtgattcaccatgaagtaaagagagagagacacacaaagaatgagatgcatgtttaagagcattttatttggcagagaaccagagatgtgagttaattattccctacagttgctggaaataattccctgtgaaggggcatttcctgaccctaacataatggaacaagtcagtgtagggagaaggagtttagctgggttcccagaagccagggtggcttggggccagggttgcctggagcctaggcccctgactgtacctgggggaaggggccagggcatccagggattatcatgtcaggccaggcacccggaggtagcgtcttgatagagcaaactggtctccactcactgtttctccctgccctcctgtttaaaaagtacagaatgatattaagaaatgaacgttttccttatttttttatttttattttttctgagatggagtctcgctctgtcacccaggctggagtgcagtggtacgatctcggcccactgcaacctccgcctcccgggttcaagtgattctcctcctgcctcagcctcccgagtagctgggactacaggtacgtgccaccacgcctggctaattttttgtatttttagtagagacgggctttcaccatgttagccaggatggtctcaatctcctgaccttgtgatctgcccacctcggcctcccaaagtgctgggattacaggcatgagccactgcacccaaccaatgttttccttattcttagcacactgcctcccacccccaatttaaatctaatgatgtattttgtccatgttatcatgagaaaagcttacaaatctgtaatcccagtgtgtgtgtgtgtgtgtgtgtgtgtgtgtgtgtgtgtgtataatataaaatctagtattacactttaaaccaagccttctatcatgagctttttctcctgatattaacagtggagagctggttttttttgttttgttttgtttttttgagatggagtcttgctctgtcacccaggctggagtgcagtggtgccatcttagctcactgcaacctccgcctcctgggttcaagtaattctcctgcctcagcttcccgagtagctgggattacagacgcgcaccaccacactcagctaatttttatatatttagtagagacggggtttcatgacgttggccaggatggtcagtctcaaactcctgacctcaggtcatctccctacttcagcctcccagagtgctgggattacaggcgtgagccactgcacacatcctgagagctggttttaatgatcacataatattctgttttatggagatgctataatccatctagccagtcctttgttgttggacacgtaaggtagtttccaaatcgttctacaacaaatgtcgaccttctgtttagggttccctctcttcaaattagttcatgaatggatgtttgcagccccccacccctaactctaacagctcaggcaataccaagcctcagggttagcccaggctcctgtaggccccttccctgttcacaaccccttccttggcatctcctcgggacctcagcacgccctctgacctgagcctgatggccctgtagggcttagccttgtccctagtctcgaagccaaagctgtgctgggcctccagtgctagcctcggttcgacttccctggaagtgggtgtgggcttggggtggcagccagttgccttccctggaatccctttctgggaagtcgagttggcttctctggctcagccccatcatgtggcccctttctggagctgctgtgccagaccagagtccctgcagggtctctgggccccctcaaaacctacaggggaaagaggaggcaaggctgggacaggatagggcctctgaagtgtgggcctgaggctttgtccttctggccatggtaccccacaggggcaccacctcctgtggtggaggccacagaagagcagtatgaggcaggagaggctgcagggagtgctcctggcctgctggcatgtggaagtgctgagtcatgctgacagctccgtggctagctgtcccagcctcttcctgctgcccctgccttggccctgcggcagggaggcctggaggcttggactgctgagcatgcagccgggttgagggccttttcctgcaggagcaggagggcagccatgtcccctctgagcccaaccaggcaccagcctcatttcctagggctacacagctagacactgggcagggtaaggggaggtccccaagtcctaccactcctcaccctacttgcatgcctgcacggcaaggagcggacagtctaggctacagtcagacctgcgtttgaatcctggctcagcaacttcctgacagcgcgaccttcagacaagtcctgtctgttgctgccgtccctctgctacccccatcccctcacatctcccaggccgggaacgttctgtttgctgggtaatttatcccaagttcagtgttctttttaacgtctcactgtcttgaaaagatcacagttgcctgtgttgaggggaggagagggcccctgtggtagagaaagagccaggtgcagcttcagtcttggggtcaagagctagtcttggaagcttggggagagcctgtcccaggaagcgcctggtcctcaagtgccctctgctctatcctccccagagccctcttgctccagggtgttgcctagagtgcctcaggcctccttggcccacctccctcctccgggcagaagcagagcttggttcccaaggttcccctttcccactggcccacccagccagtcccaaggcctcctccaacctctggttcacagcggggtctgtcccctgcagcaggtggctcaagcctattcacccacccttcctcactttcctctcattccaacaacccccatttttctagatcttattagccagatccctgttgtcctagacctctgtttcttaacaaccagtacttcttcctgagctcctgacgtcttccttcatgccattttctcttggggtgtggcttgtggtaggctgcaggaacctggtgacactgttgcccctcgagtgtaaatgccatctgttctgcatatccatgcgtggctgctcctttacccagaatgcaggctccttggatgggtgggggggtgggagccagctgggtccaggtgagagggactggcctgattcactctctgtccacagctaccgagtctattgcttgctgggagacggggagctgtcagagggctctgtatgggaggccatggccttcgccagcatctataagctggacaaccttgtggccattctagacatcaatcgcctgggccagagtgacccggccccactgcagcaccagatggacatctaccagaagcggtgcgaggccttcgggtatgtacgaggctgtggcctgagtgtggtcacagcacgggagagtggtctgtgatcacagctttgcaggtgcaggtgcaggagctgaagctgggaccttaagcaccatctaaaggtccctttctttagcatttgactcacaatttcaaactctaggcatttggacttaatggctcaggatatgtgggccaggcccagttttaagtgagtttccttgttttcgtggttgtggcatggtggctctcggagcttccacacaccatctcacgtcagctcgctttgttcttgaggaaggagggttcttgagggatgggggcttgctcggtaaagctaaaggatgtatagctgcggagaggtttgaacctcagtttggtggccacgtcctgtgcccagccccgcccagcctggggaggaggaacaggctcctggtgaaatgggagatagggtttccagatgccccccttcggccttgattggttacaaattcagggtcaaagggcacaaagcagggaggtcaatctgcatgggtgtcagccagaggggctccacctcaaagcctccaccggtgttgccaaacacaagctgctctgcacaggggcccagcattggctgaggaggctgtggaggggagggagcagggcaggtgccgtgcaaggctttgagactcaggtcaggcctccaggactgcgttttgcggatgaacccatgcctgtgactacactaagtaacaggatgcttggggttaccttgcagtagcacagcatacgcaggcctgtgttccctgatgactgacctcagaaagggagaggaggaagggaggaaataatctctgttggacaggcgaggaaactgagccacagggtcctcaccccacaggcctccccaaggccacatctatctggggactcagagtacaaccccagcagcacccccaggacctgtgtccataacctcgtgactcaagccagattcctgaagtcctggctccaccgctaacttgctttgtggcgtgggtcacgttacttactccaccttcggtgtctcagttgatttgtctgtacaatggggccagctcagcacccaagcatggcgtggtgaggcttcagtgggctaatatgggtagtggttggcatggcactcagtttgagaagtgctatttttattcttatgtcaaaaagagtccccaaaaggatagcttttcaagagaaagggtgctctgccccagctccttcctgtatatttgactccatggttcatttcaaaaacatttccagcaccacatccagcatctgtggagtgatcaaatgtgttccccaaataagaattgggccaaaaaattcatcaagaatctaatagcagacagattccaaacccagtgcgctgaccccagaacagctttcagtaggaaatgagcagatcaggaatgaaagagacaataaaggaactgagctctggattacttaagaggaggaggaaaacctgttcagaggcaaacaaaaggaagtaaaataatgtgaaaaagaaaaggatttaaaaaacccaaactggaaacaggaatgttgcaagctttctactactccagctgaggccgcagttgtggggtggagcctgggcagaccccagctgccaaggcagacctttccctggaaggctcctcggtgttgtggcccctgggaattgccccttactctctgccccctgtccccagttggcatgccatcatcgtggatggacacagcgtggaggagctgtgcaaggcctttggccaggccaagcaccagccaacagccatcattgccaagaccttcaagggccgagggatcacgggtcagtatgcacaagccgccctccccaccttcacccctcgcccagacactgtggctacgtagctctgacccgcacatccagggaaacagcccttgctgctcactgagctcaccaggctccagggaaggggagcgggagatgctgtgactcagtgacccctgtggctgagccaggatttaaactcagatccgtctggcctctgccggtgggggcatgtacaggcaggaggagaggagggacttggagggtctgtgggtgagaggaaggtcgtggagtgaggcagcccccgtgccccaccctggctggtgcctttcagagctgcagctgtgtgtgctctgccagctccggccacctgctccagctgaagggccgacacagagccaggcagggcccggagagaactgttccctccaggaggtgagtggggtactcctcaagcaatggcagatgctgagcaaggcctgtgtgggccaagagccttggggggtttggaacctgggttctgccccaggccggagaatgaggcaggcgtaagtcactccctggcacccaggtgtgggcttcagattcctaggcctgggatggcctcacccattttaaagatgggaaaatgagactacaagtggtcagggacttgcccggggacagaggaagtctatggcacgaggggggctgatcccagggcctgggtcggcttccctgccaaatgcccctggctgcccacctgcctgctctcaggggttgtggcttgttctgcccatgtagactcaggtatatgaggatgttctgagtgggggtttggcagtgctgggaggtgtctgggagggggtggatgtcgaggaaagggctctgggatattgtcatggctttggtgctgctgcctggcactgccctctggtgttaaaaatgggcaggatctggaccacttgcagcttcttgggggctcctgctagtctttcgggctgctgggtgctacctgggagttcagtctgttcttggctctggccagactctagtgactactgaggtgacctccagggagagggatattcagccttcctggccgcacacaacaaggtgccatggggtgggcatgcctaggtgcttatagactcctctgctgctcacagatgcattgggtgaccctggaagccctgttctgggccttgggttccccttctgatggccagggtcccttccaacccagtcgacaaactgagtatttctgcagcagacacctctacctgtgtgtgaccctgcaggcggggttgtggggaggaagagaatggacacattggtgaagggatggggcagtgggcccagaaacacacacctgcccacgtctggcccctcctttcccactcagctgtgagctcccaaaggaccaggcagtagacagtgagtggtgggcacgtaggagtccatcctattcactgcgaccctcctttcctggcccccgtgcctggctgggctctgcctgtctgggatgatgccattcctcccttgccctcggcaggtagagggccagtctcctggagcagcctcctggccctctgggagcttctgtcttacccattcctctgtcctcccgtgttgggtctgcaggggtagaagataaggagtcttggcatgggaagcccctccccaaaaacatggctgagcagatcatccaggagatctacagccagatccagagcaaaaagaagatcctggcaacccctccacaggaggacgcaccctcagtggacattgccaacatccgcatgcccagcctgcccagctacaaagttggggacaaggtacaaagtggggcctgtttctctgaacccatagttctcaggtttcccaagtctgtggcccagatacaccctctggagggctgggaaagggaggagagcgattcatttagggcgaggagtgatccctgaggtgttgttcctgtcacttccctcagaatgacagacatctctggagttgacctgcagaggctcagaccgggcaagggaattgcccacttagcaagcttagcaagctactgacagaactgagatcaaagccaaggactcactcccaagttcttgcatcgctggtccacgagggacccttggcctgagctcaggacccccacctgacctgggaaaggctaggcagagctgtcccactccaggtttctgtcccaagggaacccatccatgcagcctgtgcctggccttgactcccaagccttctgtgttcccatgcaaagtggaataggttcatggacctggtgcagcaggcgggaagttggggctggtgggtgtcttctgtagcttatacctttcacagccagaaggggccggggctccaggggctcccaagacattgaccgtagtcgttggcaacctttcagcagttaaaagcctctgcaggaccttgtgctccagggcttccatttttggccccgttttaatccttctctgaaagcagggctccaggctgcaggtgtgcactcaccctcagaggggtccagagccttcccactctcttcctcacagatagccacccgcaaggcctacgggcaggcactggccaagctgggccatgccagtgaccgcatcatcgccctggatggggacaccaaaaattccaccttctcggagatcttcaaaaaggagcacccggaccgcttcatcgagtgctacattgctgagcagaacatggtaggtgctggggccggcagggacaggtccacccaaggctgagggctgtggtctgaggggtgcggggcagccatgttggcagagccaggtgcctgctgtaggccagcccagggagactataagaaaagccaggacccagcgttaacccctgaccttgaacagccacagtttgggaggttctgcccaggtgcaaatgtcctggacaggtgtgcacatgggggagccgaatgggactgcaggtgctctcaggaggagctgcgtacaggccaggcctggtggtgaatggggtctcttccaggtggaggacaggcctggccagtaggtggggccgtgatgggtttagcagcccgagtctgtagagcacctgtaatgcacacggctctgggccctgccaccctgagggatgcagagatgagggaactctgggcccctgacatgtacccatttggggaagcagacccttgtcaggaactgaggttgtgaagtaaggaacaatgttttgtccatgttttcaaaatatcccctcctggtggtccaggagcccagcctggcttgcaggcccctagggacagggagcttcctctctctggagggcactcagatctccagagttcttccaactggacctgaaattctctctgtggtttccagagactgctctgcagggcgtggggctggggaggtcccaggtactagggaaagaggccttgtgttggctggcagattttggagccttgaagggcagctggtttggaactgatgactgtactcagtgctgcttctggatgagtgatttggggcctggagcctcagcaggcatgaggctgctgccctcggaccccagggaggggttgggaggaccggtctctgcagaagaaggtggtgggggacatattcagaagcccagaaaggatggacaatctatatacaaattgtggctttctccacaaaaggggtcctaggctccccgaccaccctctgcctgcccctttgggctgaccctgtcccacctgcccccaggtgagcatcgcggtgggctgtgccacccgcaacaggacggtgcccttctgcagcacttttgcagccttcttcacgcgggcctttgaccagattcgcatggccgccatctccgagagcaacatcaacctctgcggctcccactgcggcgtttccatcggtgagtttagccagggtgtttacacctggagctcccttgacttttgcaccaggaggtatgggagggggatgggccaggattccagcccatggatgggggggtaggggtcttatttctgcatatcctttcccccacaccccaggggaagacgggccctcccagatggccctagaagatctggctatgtttcggtcagtccccacatcaactgtcttttacccaagtgatggcgttgctacagagaaggcagtggaactagccgccaatacaaaggtaggttgcatggctgttctttctcctgctggcagccatcacttcccaagggaaacagaagaggaggccagagctggtcacttgctgccccagggggtgtttcctgaccttgcccctggtgttcgtgtagcttgtggaagttagacaagaaaaaacgaaatacacaccccacttactgccacgtggcagacattgtcaactgattgccagtctgtctctgctgagaatcctggcagccctggccggtccagcggttgacacctctccaccctcctgagttgggttctccaagacaggcaaggatgagctgagccctgtggtccaggcccggagctgcatgccacagacccagtgcgcgtggttcctgcccctctgcctggtgcagtctgtgggagtagcccacctgcagccagtctacctggtggaaagttgccttcggtctgaggctgcaaggtggtgggcagttctcagagtgttcaagtggggtgcgggcggcagagggcaagcaaggcccttttccctgctggagtagccaggatgcagtaactaacgctcccatgggaagggatggcctctctagaaagacctcgtctctgaggttgggtgtgccacatcctgtatcctcagtttatctgtttcggtctcagggtatctgcttcatccggaccagccgcccagaaaatgccatcatctataacaacaatgaggacttccaggtcggacaagccaaggtcagtgcctcgcatgccccaggagcccacagagctgcctggaccctccctgctgtgactcccagcagtcagggcacaccctgccccagggccctgagccttactcaccctctgtgtcacccccaggtggtcctgaagagcaaggatgaccaggtgaccgttatcggggctggggtgaccctgcacgaggccttggccgctgccgaactgctgaagaaaggtgaggagaaggggcctccaaagtcatcaactgagcggccactgcatgctaggtcttggggttctttctttcgttctttctgttctttcttgaagagctcacagctagagagaaagcatttcatttcattaaataatgatagcaattatagccatcctttgagcacttgttctgtctggcatgttgctaagtcctggggctgcagtgcccacagtccctaccctatgactctaaagtcgagacccccccagcatggtggccagatcagtggcctggagcctgccagctgggctggaatcactcagccaggcactagttaaggaagtaagttattcactgtcaccatgcctgttttcctatctgtaaaatggagatactagccccttgccctcagagctctcctgagggttacatgcatgtgacttggtattctattattattactgcgagctcacagtgttggctagtggtttgtaggggagacaggcattggcctctcctgcaatagaatcacacagcagatgtcatgttttagcacgaaagagggggcaggtgtggcatcttccagaaagtggcttcagagtgggtaggaattgattagcagagaggagagtgaagggaggccggaggagggtcaggcaggagcaagatggggctggaggagccagaggagtccatccccaggcagggggagacccaggggggtgagctttaagcagggcctggcaagcgtgggtttgtccttctgagaaggtgcctctgctgctggggccgcacgtgggcctctgatcactctgcgggctgcagctccccaacgtcaccacatcaagcctcaccttccatcaggccagacacctggggtgttttctctcgcattccctttgtcttcaaggttgtgggaggatgagggaaggcgctcagggcctgcacgctccgctctgggttcttggatactgcgggcaacacagctggaccagatgccccagtgcaaggggttggcaagcatgagctcagccatgggaacgaggtggcaagtggttctccctgggacagggacaggcccgcaggctgagctcttagctacacgcagccctcaggatgtcccaccaggcccccaccagggcagatagtggtgcccagccctcccctcagccacgccgtgtgctctccctcacagaaaagatcaacatccgcgtgctggaccccttcaccatcaagcccctggacagaaaactcattctcgacagcgctcgtgccaccaagggcaggatcctcaccgtggaggaccattattatgaaggtaaggaggcctggggcaggcaggctgggcaagggacagggccagagagccgagcgttggacgtgcctcttctatctgagccccaggagggcagctgtggcccagaacacccagagctgtccctcagagcagctgggacgtggtctcttaaaaggcctcaggcttggcctggggacctagctaactcacagctgctgatgagctctgtggagctcctgctgcccaggaagctggtgaggattccaacctcgctgctaaatggtggatggtggcgtccctgaggtagtgtagggtggaagctatggtgcagcttgggaagcaatgcagaatttctggtatttgtgagtccttcacacagcaggctccctaagtacacaccagcctctctaagtaggaggccccagtgggagagatgggctttgactctggggtcaaatgtagataattggactatggacagtggctggctggtcaccaacaatggtgtttgaaacaaacatttagaggccatatttgggcttataaaaatagttctgggccgtgcatggtggctcacacctgcaatcccagcactttgggaggctgaggacagcggatttcttgagctcaggagttgggagaccagcctgggcaacatggtgatacctgtctgtctctttaaaataaaaaaaatcaatgagttatgtgatgggctcatggctacaggtggagaaaggcagtgcatatgcagcctcctccatccttgactaaggctgacagagggctgggcccaccactgctcaccctgaggcctcgtcttctgactcccctcctttcatttctaggtggcattggtgaggctgtgtccagtgcagtagtgggcgagcctggcatcactgtcacccacctggcagttaaccgggtaccaagaagtgggaagccggctgagctgctgaagatgtttggtatcgacagggatgccattgcacaagctgtgaggggcctcatcaccaaggcctagggcgggtatgaagtgtggggcgggggtctatacattcctgagattctgggaaaggtgctcaaagatgtactgagaggaggggtaaatatatgttttgagaaaaatgaattggccctgaaatgttttcttttttgatgtgtttgcagccagtgcaggttctggggaagaagcgtggagggtgcgctagggaggctggtgtccttggtcctgggccaggacctgggtgtcccaagtccccttggaatcacctgcaactgccctcaacctccagaactatcgctgcctcccattcatcaccaggtgacatttgactgcaacctgccttctagctgagaggctgagacctacatccctcattgtgacctcagtccacctggccctgagcgggctggggaactgcctcagtctggaagctgaccaggcactctcagggccgccccacctcccccaagtccccacagccttgcagtcaggtctcctgggatagggaggttcacttgcttgttgtccctcgtccttgtcatatccttttaactaggcatctcagagaagcagagacagggcagccttcgtcctgggggaaaagggaccctcaggatggcatgagaggtcctcaatcccaagtgtggaactgtccccctcaacttgttaaaatgcagatttctgggtcttgccaatggggcctgggactccatgtgacaactggcccaggagcttctgatgtcacacagaattctgcagtcccaagctccagccccgacctgctctgctgttcctaggtgactgccctcacactgctgaccacagtggatttctccccctgctgctcgggctcagctggggtcagccctgcttataaggtcaactgtgcaaaaccttatactggccaagaacaaactagtgctgggggaggagggctgggtgccccggccactggtggagtccccaggaaatcctcagagctgttgcgaggatgagacacatttgtggacacgtccacctgtcctcctgaccgtctggagagaataaacctgtcaaagccaaggtca

SEQ ID NO: 14 - DNA, 166118 bp, Homo sapiens
attgcatttctggacgcttctagacagtgttcatacttggctgtctggtttcaccaggaactctacccaaaagaggaaacagcaaggagaacatttgctttgtttgtaggagggaagttgtcgagctacaaacaaatctttaggcatctgaggaattgctaagtttctaatttcatatggttgctgacaaggaggtgcagacaaggaccctcttgctttcctcactatggatagtctgttgcctccatctagattctcttatttcaaaaaatatcctctccatgcaattaggagatatttatcgacgctgagaaaccaaagagccgaagaacaggtatcattttgtttatattatctttaaaatgaacgggtgcttgttccttgttgcttttacgtcgcttagtgatttcatttgtgctggtttacatgtttataggtacaggtcagatcctgcttgtggctgttcagacttggcaatcagaaagcaagcaggcttgtgagaatttatttaaacttggaacattcagatcctgagattaagcggagttctgtaatgaagccacatgctttctttcttctaaagagctactctatcaaagttaaattttgaattctttgatcattttccaatgcctcagatacaaaatttgacactattaatatctcaacaaagaaagtatcagaccctagaagtacacttgtcttcttgtatttatggttatgtttacatagccagaatttgcaaaacaaaaaacattttataaactataataaccttaaacagatcattaacaagctataaagatcattcagaagcagttggtcatttttgtgtgtgtaaaaggtaggaggtagagcactgccatattcagtctttttagccaatcaaaagctatgatttccagcaggagacactatcacttgggaatataagcatttttaaaactgttaaaatgtctgatcacatctcatttaaaatcatgcagtcatttttatggtgtgagatttatatcattccatttctttgatctccaaaaaagacatttctaaaaatgatttttatgaattttaccaaattgttagaagaagtagcaatatctgatccatttaaatctagtgattcatttaggaagaagtgtggcggtggtatacaaatgtgaaggacaaatgtatagccataccaaagacccagcagtcataaattgcttgtgcattgtgcttgtaactagaactgcaaaactatgcaggagatatcaccagtgtcctgtatttttttctcctttgtgatatgagatgacccacttaataaaacacttccaggaaatgcaagataggtttagcagacagaaaatcctctcatgacaggtttcccaaaaaggcaatgcataatttggaaaataaaaatcattgctactgtttgagaggaaactgcttgtatgccctgctttaataattttacaagggccagaaattcaaacagactctgttcactaagggagctaggctggtccagtttatcttacttaggcaaggtgtcaccattaaaagaccaacttttggtttccaagtttcagcctgcacttgcttttgatgtagaaagctagagaaccaagtggtagggctgtataagtttttgtttgccaatcttttaatgttcacgggcttcttcaggcctcatttattatggaaggaagagaggtggctgaaaggatgggaacacaactgtggaatgtgaattgagtgattttttttttctcagtattgtaagttttcagagatgtggctatattgcttgtgtagttctatggttctttgtttttagtttattgaagaagtattacaaaatgcattcagaagaccattagaatttaacataaaacctctgacttggacagggtgggtagtcccttccccagtgtacaaccatttgggacaacctaggaacagctgggagtgagtattatgctgagttcttaaattcttatataagtgaattgaataattaagagaaataatatatttgatttctttttaaagccaactacagctctgcagacctaatgtctcacagaattagagaaattaggtcagagttcatcataactaaccttgaaagcttgttgggaagttataaaggaggttaataatgtctacaatcttatgacctgcatatttgttgcctctaatccttacattcttgtataactaatccttgatataaaagtgaagggattgagacttagagcccttaagagcccttgcccatgcagctagaaagtaccagaggaagatgtgaatttctatctcatggctttaaattttattcattttaccacgcttgatccctgaacaatctagtaatagcaaaatatcaccctgctaacttttctccttgagagatttctaaaatttcctatattcacatagcactgtcataatttttactgtttaccacatctgtatgattaattcctcaatatttttctgtatttgtacttaaatcacattattagagtttatttagaaaaaaagttcatatcatgactgtaaatggaaaaccattgtcattagccgtaagtaaaaataattaataaaagcaaaacagtattaaattctaggtagatactattgcctgtaaaacctccaagcctgaaacctgctcatttgttaataaggaagattagcttttaagagaaaggttagagcatcctaggagccaactgagaaagtttcctgggtgaggatggaaaggaattaaaaggtagataatgtttttcaatccaaaatgattcagtgttattgaatgtagtgtctgcatgccacttaaaatcttctcccacctcacttagcgctgctaagtaccaaccatgttgacttccacatacttggggaatattataacagaacaccatctgcttctttacttttgcacatttaaatgaactcccccctctagcctagaattctctcctttacttacaacttgccctcctggaggtctcctgtacatccttcaatacttggattaaatgggctcagtgaaaagctttctccagtgctgctgggaagaatgaagtcttccttttccaagatattttgtttgcttcagacacagcccttactacattctatgtagtaaatcatgtgatttcatgtcgatattcgtgcacccatgcacacatgacactggatgttatcttgttctttgttccctgaggcatactggagcctggcagatactggtgtaaaggtgacccacacaacaggcagagggtacacactggattgactgtgacacagacctcctttgttgtttttactaggcctagaagttccccataccccttttctgtggtccaaattatgatcattgttacactcaccttgttcacatatgctttattgtttaaaacttctcctagtgctcttctcgcacttggtgtcatacagacaagaagatttgacatgagggttgatttgtttggtagctttttctggtggtggtagtgttattcctgtgatacagccatcaataggttggtaggttatttatcaaattgagaacaaatatttcatcctttgcttccctagattctcttgcagcaagtgtttcacaaagccaaatccccacatatgtagaagattaacagcattaatgagatgaagatgctgaaggttgggaaaatttgttaacctttctctcagaattattcaaatggtgtggtagtaacagtggtggtggtgaacgttgggcagcctgagcctaaatggagtctcagatgagtttgagtaggtgtgctgaacgcacgcataagggtgtttggtttcggttattttattttggtctgagggcaacatccagcacctggctcagatgttggtgtctagtttataaggaatgagtgagacttgcaggcaatgttcccctaagtactagagactcagcagcctgatctgtggctcaggtgatcaagcgggacactgagtgtggaagggagaatttgctccacttctgggctgactatagtctagctttagcctggagatgcctgccaagaaccaaatacctcatgaacccctggggagtactgctcttaggggccagcacccctgggctacatatgggtgctagcaccaaacaatgagaagacagtttgtcagctcatgtgggacagtctactctctctccttgggtgagttcttctattcccatggtttcaaacacctatttgctgaaaactcccaaatgtttatacccagagcacttcagccttgcatccaatcatctacttgatatctccatctgaatgtcttgtgaatgttgcagactgaatgtgtccaaagagaattccacaagctccaaacatgctcctccccaggtttttccatcaatcaacacaaaagctcaaaccagaaacctgggagtcaccttggcacctctctttttccctttctcccccttacgtccccttcctaatcctttagtaagacttctaaaatagttattgaattctccatcttcacccttctaatcctgccaaccatcttttcttacttgaactattgcaatagttttccaattcgtgtctccatgttcactctggttatcctacaatctgtgtctcctgtagcagtcagaattttctgctttaaatgaaaatcttattttagctcaatgcggggaatatgatattattttgtttgctagtttagtcccagtgctaagcataaatctggcacatagatgataaattaatgtaattgaatggaaaaaggggactttgtaagtattagagaagccgtggggttggagggttcacggggctgaggtgtttttatgcaggtgagggtaagagatggtgaaaatagggttattatccttagtaagcagaggctgttgagatctaggggaaatcatgtagaggaatttattttacagacgtgaaactagtgtcacaaactaagagatttgcccaagctcgcatggctcatctgtgtcagtgctgggattagaatttggttcgcttgactctcattctgttatgtatagtgaacccctaagcagagatgtagaaaaaggccatatgagaaaaaaactctacaggatgggtccagagaataggtgatgcctgagggtcaacttgtcaacttgtcaataacaaataagacgttttgatgagagactgaggcagagcagagcctgctcttttttgccttgtccctcaacttacactgcccttcagcagcctcgccagtctgaatccccacttctatgtgtccctgcaggaggaaagccgagaaggagtcagaaaacacaggccagctaatttaatctacaagaatttgggatgacctgtaccaatgtctcgctctcttgaacagagattttttttttcctgattgagaaataccattcaagggctgatctgacaagtcttgcctgtttaacagtgaatctgcttaaaatgaggagagtggtctttgggcccagggggcatgtactgtagctacattttaattacagagtagaatcaaattttgttttggaagctgttctaaagtttcctttcaatggcttaagaaaatgtttctagttggaacgggatcactggaattttttttctttgctgctctgtttcttaatgaatgctaacctcaaagttgcactgttaaataaatatttgaatttaatttgaattttagaaacttatttctgcattttggctctcatacttactctgaatgatactataaaaattaagaactccccattccaaagaaaactatattgagatttccaaggctaaataaggatttgaggttgctgatgtaggctctgattctctaggtaaaatgatagacgtttcactacaacttgatttaagaaatgtttttagctccataaagtcagtaagttggttatatcttgagtgtataccaaagctattcattgtaaaaagtctttttgaaaagtcatgaaatgctatccattgtcagttcaaatgatatttgaggggaaactaaaagtgcttctccatgtccccttagccccatgcttatgatctttcattggcttccatttgctttttggatacagacaaagctccctaatgtggaggggtttgtgtggtccagctctgattctctccctgctgcatgttgaccttgccccctgtgcttgtgcttgagtagaaaaaatttcagtccttcacaaacaggaggaaaagattttccttgtagaacttaataaatgttatctcatttatacctagtgttccattattggaacaataagcatgtgggagttatttacatcctactgctcaaggccatcgccaaggtctgattgcaaaaattcaaaaaattgtaactttgggcacaaatgggttaagatagaggacagagagtctatgccactcctgtggaggaatttgtataattatatataggtaacattgacagttaaattgtgacaacatgaagttgaactttaatatttctgattattaaatgtgacattaaaagtggaactattttattatggtaatgacaaccttttcctctatctgaagggagaaattttttaaatgagctatgtatttaccaaaaaataaaaagctaccaatggtttttcacattatctacaagatgcctgagagttatcattgatagcttgcataaagataaatggctttctagttgtcagcaaccaccctcatggtctttctctctcccaaatatgtcttcactatctaagaaaatatcaccatcctgatatttaggcagaggcctaggttcatctttggtgctttctgctcccttagtcaatatttaatctatcaccaactccattcaattctacccctaaaaaactcccaaaccggttggtctacttccctctttcaccaccctagcccaaagaccgtcattacttcttgcctgaaatactgtaataccttcctcattggtctcccagtaatccacactacagtcagagaggtcttctgaacactaccacctagccccatgcttatgatctttcactggcttccatttgctttttggatacagacaaagctccctaatgtggaggggtttgtatggtccagctctgattctctccctgctgcatgttgaccttgcccctctgtgttagttagggttctctaaagggacagaactagaggatatttgcatatatgatggggagtttattaggagaattgactcacatgagtcacacgatcacaaggtgaaatcccacaataggccgtttgcaagctgaggatcaaggaagtcagtctgagtctcaaaacctcaaaagtagggaagctgactgtgcagccttcagtctgtagccaaaggcctgagagcccctggtaaatcactggtgttaagtccaagagtccaaaagctgaagaacttggagtccgatgttccagtgcaggaagcatccagcatgggagaaagatgaaggccggaagactcagccagtttcctcatgccactttcttctgcctgctttattctagctgtgctggcagctgattagatggcgcccacccagattgagggtgggtctgcctctccctgtccactgactcaaatgttaatcccctttggcaataccctcatagacacatccaggaacaatactttgcatccttcaatccaatcaagttgacactcaatattaaccatcacaccccctgttctctgaaccctagctatagcacacttcttctatgtatgcaagtttccctgctacttcctggctagggcatctgttccaataatcatctttctatcctccctcagttagtatctactcttccttcagattttaattcaatattaactcctttagagcagccttttctgacttttccaccttgcttcattacatcctttgaaggcacttggtaactgtcctttgctgtatttatcctagtagcaatttcgcatctttctgtgggggctatttgattcccgatgtatcccaggtgactagcaaagtgcctgacagatggaaggcactgaatacaagtttgtggaattagtgaatgtggggagtaggggtgcaatgaattctatcttgagactgaagtacttgaaataatcctggatgttagactttgtgaggaagatacatgactgcttttgtatatgtgtttgtgtatgtgttttgtaagaatcttagggctgtagtaccagaatggctgagtgattaaggtattggacttaagaatcatagggctaattcatgaagaaagataggtatgcatttgggaggttccggaggaaataaccatgaccaatgggtagaattgcagggagggattatgatatactaataaagatgaactttctaaaaatgaaaggtaaagaaatgaattatcttctgcagagtgcgggggtatgtgacccctccttaggggatgttgtggcaatggtttctgcatcataaaagagaagactgaatgacttattaggttccagctctgatattctagtataataggcaatagagagatgaacaattcagatattttagaaataaggagagggcagagggcatagatgtgtagttaggattcccgttttatttggttagtggtaaatactccatagtcttagcatgttgctctagagtctaagaccaaagaagacagaatcaaatgcctttggtgattagagtagcatgtaattctccgtcaaggtaaaaaacaaaagttacatctagcaaagacctcaagtgaagagctatgtacctgtgactagcttttctaagcctaatcgaccacttaactacttctaatccatagtttgtaagttatctaaccccttccagtataacgataaatagctaaatatacatagcagtcattgataaatgggggtgccaagaaatttcaggttattttgtggcactttaaccactgttgttttttcttcttcttcaatcaagcctcttttaccttcagattttcttcaatgcagtcagtgctggcaacttgccgtttattatggtcccttctgaaggtgttccatccttcttgtccacagcatcacagcagtgaagtgtcagacaagcctaagagacacctggaccctgggttgatttctgagctatttttaatcccttcatttactttaaaatttttctaacctactgtgctctggtgcctttgaaacatgggagtcagtaaatggatgaatatcaaaactgttgctttgtctttgaaataagcacattattagaataagaaattgaattagaaatcacaacaaattacaaattcgaatgacaaatatcacaagcatcaaaaaaatctagaaaataagtgtttttaccaattaaaagttaacagatccatcctaaaatattttgttcctacattgtgggggccacagggtctttaatcacctcctcataaagtgatggtttttaaatactctgtgaagagatagtagaaagataatttggatactgccctaatacagttaatgtatgattatttttcattaaaacaaacataaagtgcaaaacccttttctgtgacagtgtagcttttttaaagattcctaaatttgctatcccattccatgttttagacagttcatctacacttcgttagcttttgttcagaatgaaagatgacatatttttgcaccttgtacagacagtcccatgtcttgacagaaaacaaaatgaaaatacccacatatgttgtactgctcatgatttgctgtgaagagagcaggaaaaatgttggaattatttctttcctactcaccctaaaggtggcatattagtaaggctatttcaggagatacaacttaggttatgcattcaagaataaaatattttaaatttgtattaaatgccttatatgtgtcaggcacttgacaaggtgctttacgtatgttgtaatttatttctcataataaccttgcaaagtcagtggtattatccccattttgtgggtgagagaactgaggtttcaagaggtaaagtaacttgctacatagctcataaatgatgactctgagattttagctccaggtttgtctgtttgacctcaaagcccaattcattccctcatacagagatacctcccatagataggattcctttctctccttcttcccttcactccttcctttcttactttttccttccttttttccttgacctcagattttctctcatttatgaggataaaggagttgaaaataaaaccatcataactattgtgtttggaagataccttaaatcttttttagaatgagaaatataggtggaaatacaggtttttgcaaagtttaaagtttattcaatttgggagactttgtttaagaaaaagaatataaaatctgtatcaggtttctcgacatggtgcggtggctcacgcctgtattcccaacactttgagaggctgaggtgggtggatcagttgaggtcaggagttcaaaaccagcctgacaacatggtgaaaccctgtctctactaaaaatacaaaaattagccaggcttggtggcatgcacctgtagtcctagttactcgggaggctgaggcaggaggatcacttgaacctgagaggcagaggttgcagtgagccgagatcacgccactgcactccagcctgggtaacagagtgagaccttatctcaaaagtctgtatcagggttctctaggaggtgaggtatttattatgggaatcggctcatgcaattatggaggcagagaaatcccataatctgctgtctataagcttgagaacccagaaagacagcaatgtaatttattcagagtcagaaggcgtaagaactgggagcactaatgtctgaaggcaggagaagatcaatgttccagttcagagaaagcaaattcacccttcctctgccttttggtcctatttgggttctcaatggattggatgaggaacgttcatactgatgagggtgaatcttctttactcagtccactaatgcaaatgctaatctcttcccccaaacaccttacagacacacccagatataatgtgtttttttatttttatttatttatttattttaccagctatctgaccatcccttagcccagtaaaattgagacataaaattaacatcacaaaattgtcaacattaaagtagatacgaagtgaatacttatttagaatggaagaagaaatcacaacaaattacaaatctgagtgacaaataccataggcatcacaaaatctaggaaataagtgtttttaccaattaaaaattaatgaatacaccctaaatgttttgttcctacaatgtgggggccacaggatctttaatgacctcctaacacaatgatgatttattttgattttgattttttaattaaaaaaattttttttgagatggagtttcgctctgtcgcccaggctgaagtgcagtggcgccatcttggctcactgcaagctccacctcctgggttcatgtcattctcctgcctcagcctcccgagtagctgggactacaggcgcctgccaccatgcctggctaattttttttttttttttgtatttttagtagagacggagtttcaccgtgttagccaggatggtctcagtctcctgacctcgtgatccctactccttggcctcccaaagtgctgggattataggcatgagccactgtgcccggcctttatttttatttattatacttacttattcactttatttatttatttatttatttatttatttatttatttatttttagtaagagacagggtttcagcatgttggccagcgtggtcccgaactcctggcttcaggtgacctgcctgcctcggcctcccaaagtgctgaaattatgggtgtgagccaccgcacttggctgattttttaaatattctataaagagataatagaaagataattcagatactcccctgacatagttaattgtttttcattagagtctagaaaagttccatcgcctagcttttggctctgtttctcctttactacccacatacttcaggtgctgagcaccataggacatatttatatgaagatttcagcccagtgatttagtacaggtagtagggatattcctgtatgtcatttctccaccaaaacatttagcaataacttaaccatgcacaggcatgactacaaaccacaattatataatccactaaatccaaatgaaatctaagggtatccccatctcaactttctttgagccagatccaagacatacctatggccacttcagtgctacctgataggagtagaattgtgaaggagggatagccagtaaaaagagtgctctcaagccaattgcagttaaaatatattttgcaaatttttaacgaaacataagattatgagaacaatgctagagtctttctcggggccttaaagagggttctgcaagtgagggaccttgaagcttaagctttgttggcttccaagaaaacccagctctggaggaaaggtgtaaccaaaaaaaatggtattacactataatacacaagagtccatgccatatagcgcttcaaaaaatgatgttatatgagatcctattctgagcagcttcagctcccaaactcattgaatgaagtagaggatgttctattcagtatattttataaataatatgttgaagatatagatgttctggtactgctaaaactcaaaggtctcagactcctctgccaccatttatattcaaaaaagaattatttgcaaagggattctttgcaaatacaaatagatctctatactcctatattagtctaattaatattaaacacaccatttactattcttccaagcagaccagttaacacacacacacacagagaaagactgtgttattgctgtttaagatcacatagtggaaaaactaaaacatcactaaagaaagataaagtctttaagaattcattaagatgtaatcaagcttttgcaaactcatgtgttatttgcaattatagtatagtgatatggtttagctgtgttcacacccaaatctcaattaaactgtatctcctagaattcctaggtgttgtgggagggacccagggggaggtaattgaatcatgggggctggtctttcccatgctattctcattatagtgaataagtctcatgagatctgatgggtttatcaggggtttctgcttttgcttcttcctcattttctcttgctgctgccatgtaagaagtgccttttgccttccgccatgattccaaggtctccctagtcatgtggaaatgtaagtccaattaaacctcttttgcttcccagtctcgggcatatctttatcagcagcatgaaaacagactaatatagtaaattggtaccagtagagtggggtgttgctgaaaagatacccgaaaatgtggaagtgactttggaactgggaaacaggcagaggttggaacagtttggagggttcagaagaagacaggaaaatttgggaaagtttggaacttcctaaagacttgttgaatggctttgtccaaaatgctgatagtgatatggacaataaggtccaggctgagatggtctcagatggagatgaggaacttgttgagaaccggagtgaaggtgactcttgttatgttttagcaaagagagtggcagcattttgcctctgccctagagatttgtggaactttgaacttaagaaagatgatttagggtatctgacagaaaaaatttctaagctgcaaacattcaagaggtgacttcatcactgttaaagacattcagttttataagggaagcagagcataaaagtttggaaaacttgcagcctgactatgtgatagaaaaggaaaacccattttctgggaagaaattcaagttggctgcaggaattttcataagtagcaaggagcctaatgataatccccaagaccatggggaaagtatctccaggccatttcagagaccttcacagcagcccctcccatcacaggcctggaggcctgtggtttcgtgggctgggcccagggtccctgtgctgtgtgcagcctagggacttggtgccctgtgttccagccatggctgaaaggggccaatgtacagctcaggctatggcttcagagggtggaagcccgaagccttggcagcttccacgtgttgttgagcctgtgaatgcactgaagtcaagaattgaggtttgggaacctccacctagatttcagaagatgtatggaaacacctggatgcccaggaaaatgtttgctgcaggggtggggtcctcatggagaacttctgccagagcagtgtggaagggaaatgtggagtcagagcccccatacagagtccctactggggcactgcctagtggagctgtgagaagagggccaccatcctccagaccccagaatggtagatccaccgacagcttgcaccgtgctcctagaaaagccgcagacactcaacgtcagcccatgaaagcagcaaggagggaggctgtaccctgcaaagccacaggggtggagctgcctaagaccatgggcacccaatcttgcatcagcatgacctggatgtgagacctggagtcaaaggagatcattctggagctttaaaaattgactgccctactgaatttttggacttgtatgggcctcgtaacccctttgttttggccaatttcttccatttggaatggccacatttacccaatacctgtacctccattgtatctaggaagtaactagtttgctattgatttacaggctcataggcggaagggacttgcctttctctcaggtgaaactttgaactgtggacttttgggttaatgctgaaatggcttaagactttgggggactgttgggagggcatgattggttttgaaatgttaggagatgatatttggagggcccaggagcagaataatatggtttgacagtgtccccacccaaatttcaacttgacttctatcttccagaattcccatgtgttgtgggatggacccaagtggaggtaattgaatcataggggccagtcttcccggagctattctcatgataatgaataagtctcacaaggtctgatgggtttatcaggggtttctgcttttgcttcttcctcattttctgttgctgccaccatgtaagaagtgcctttcacttcccgccatgtttctgaggcctccccagccatgtggaactgtaagtccaattaaacctcttttttatcccagtcttggggatgtctttcagcagcatcaaaacagactaatatacatagtttctgaaacttgtctgatactctagataaagatcatctttatgttgatttaaaaattttttaactttgtttaatccccataatcatatattgaccttttttgctgaattttgctcattgagaatgtattgaaatgtctacttttttcatatatatcctattcttagctgaaactctagaatcctccttttttgattatatatgcataattatccttaaatgtaagcagtgcttacaattctgttctgtaccattactatattacccaagtttacaacttaactagaccatggcttataagtcatctaaaaataaataaagcaaattatagaagtattttagccttaaataatgaagacatgtttgtttcaagtgattaaatagtgagaattgtgtaaagccatttcactagcgtcaaaaaactccttttgctctgtccccaacataaaatttgtgtgtaatatacttgaaatttttagagcctctgaaatgttatccaacttattttctttaaggataaaattatttgtttgagaaacccagtttcaagaaaatggcattttatccttactttgtgaagcttccctactcctcttctttcatctaactggtgctgctaaagcctgatacacctagtcaaagaagcattgttccaaaggtcctgacctggaataagaaaacaaaaactggcttcatagctaggatgacaactgtagctccattatcactgaattgctaactttgttcttattctctcaaactgtggttttgccaatgtgatactcaattacctaagaggggagaagtatgatttctttatgattttaatactctttcctctcatattttaaaatagctggttttaggccaataagtgtctactcaaagaaattcaaatccttatataatttaagaatgctggaggaggtttaaatattcatgtacggtcatacttccattttattccacttcacttatatatacatagcacttaacaggtaattgtgttttttataaattgaaggtttctggcaaccttgcattgaggaagttcattggcactatttttccaaaatcatgtattcacttcatgtctctgtgtcacattttagtaattcttgcaatgtttcaaactttcccattattattatatctgttatgatgacctgtggtaatttttgatgttactattgtaattgttgtggggtgccctgaatcatgcccgcattagacagaaaacttaatggataaatgtgtgtgctgacttctccactgaccagtgatttccccagctctcttctccttgggccttcctatttcttgggacacaatagtactgaaagtagtccaataataaccctacaatggcctgtaaatgttccagtgaaagaaagagtcatacattcctctctttaaatcaaaaaatagaaatgattgtccctctccctctccctctccctctccctctccctctccctcacggtctccctctgatgccgagccaaagctggatggtactgctgccatctcggctcactgcaacctccctgcctgattctcctgcctcagcctgccgagtgccgccacgcctgactggttttcgtttttttttggtggagacggggtttcgctgtgttggccgggctggtctccagctcctaaccgcgagtgatccgccagcctcggcctcccgaggtgccgggattgcagacggagtctcattcactcagtgctcaatggtgcccaggctggagtgcagtggcgtgatcttggctcgctacaacctccacctcccagccgcctgccttggcctcccaaagagccgagattgcagcctctgcccggccgccaccccgtctgggaagtgaggagcgtctctgcttggccacccatcgtctgggatatgaggagccccctctgcctggctgcccagtctggaaagtgaggagcgtctctgcccggccgccatcccatctaggaagcgaggagcgcctcttccccgccgccatcacatctaggaagtgaggagcgtctctgcccggccgcccatcgtctgagatgtggggagcacctctgccctgccgccctgtctgggatgtgaggagcgtctctgcccggccgctccgtctgagaagtgaggaaaccctctgcctggcaaccgccccgtctgagaagtgaggagcccctccgtccggcaaccaccccgtctgggaagtgaggagcgtctccgcccggcagccaccccgtcccggagggaggtgggggggctcagccccccgcccggccagccgccccggccgggaggtgaggggctcctctgcccggccgcccctactgggaagtgaggacccctctgcccggccagccgccccatccgggagggaggtgggggggtcagccccccgcccggccagctgccctgtccgggaggtgaggggctcctctgcctggccgcccctactgggaagtgaggagcccctctgcccggccagtcgccccgtccaggagggaggtgggggggtcagcccccggcctggccagccgcccagtccgggagggaggtggggggtcagccccccgcctggccagccgccccgtccgggaggtgaggggcgcctctgcccggccgcccctactgggaagtgaggagcccctctgcccggccagccgccccgcccgggagggaggtggggggtcagccccccgcctggccagccgccccgtccgggaggtgaggggcgcctctgcccggccgcccctactgggaagtgaggacccctctgcccggccagccgccccgtccgggagggaggtggggggggacagccccccgcccggccagccgccctatccaggaggtgaggggcgcctctgcccggccgcccctactgggaagtgaggagcccctctgcctggccagccgccccgtccgggagagtggtgggggggtcagccccccgcccggccagccgccccatccgggaggtgaggggcgcttctgccccgccgcccctactgggaagtgaggagcccctctgcccggccaccaccccgtctgggaggtgtgcccagcggctcattggggatgggccatgatgacaatggcggttttgtggaatagaaaggcgggaagggtggggaaaaaattgagaaatcgcatggttgccgggtctgtatggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaatcagagacctttgttcacttgtttatctgctgaccttccctccactattgtcctatgaccctgccaaatccccctctgcgagaaacacccaagaatgatcaataaaaaataaaaaaaaaaaaaaaaaaaaaaaaaaaaaagaaatgattaagcttaatgaggaagcatgttgaaagctgaggtaggctgaaagctaggcctcatgcatcagttagccaagttgtcaatacaaaggaaaattcttgaaggaaattaaaagtgctactccagtgaacacacaaatgataagaaagctaaacagtatttttgctaatgtgcaggaagtttgagcggtctggatacaagaccaaaccaggcataccattcctttaggccaaagtctaattcagagtaagtctctaactctcttgaattctgtgaaggttgagagaggagggttagctgcagaagaaaagtttgaatatagcagaggttggttcttgaggtttaaggaaagaagcaatctccataacataaaagtacaaggtgaagcagcaaggagtgatggagaagtggcagcaagtaatccagaagacctagctaagatcattgatgaaggtggctatactaaataatagattttcaatgtggataaaaagccacaggctgactttcttgtttggaaccagtacagctgttgactttaagttgaagccaatgatgatttatcattctgaaaattctaggtccctaaagaatgatgctaaatctactttgcttgtgctctatcaatggaacaacagagcctgtaggacagcagatccatttatagcatggcttactgaatattttaagcccactgttgagacctcaaaaaaaaaaatagattcctttcaaaatattactgctcttcacagtgcagctagtcacccaagagctctgacatgaggtaaaaggagaataatgttttcatgtctgctgtctgttctgcagtccatggatcaaggaagaattttaactttcaagtcttattatttaagaaacacatttcataaggctatagctaccatagatagtgattcctctgatggatctgggcaaagtaaactgaaaactttccagagaggattcaccattctaggtgtcactaaaaacatttgtgattcatgaaaggaggacaaagtgtcaacattaacaggagtttagaagaagttgattccaaccctcatggatgactttgagggattcaagacttcagtggaggaagtaagtacagatgtggtagaaagggcaagataactagaagtggatcctgaagatgttactgaattgctgcaatttcatgataaacgttgaacagatgaggaattgcttcctcataagaaaacacagaaaatgttttcttatgatagaacctattgctgggtagatatgctgtgaacattgttgaaatgatgacaaaggatttagagtattttataaactgaggtgataaagcagtggcagggtttgagaggactgactccaattttgaaagaggttctactatgctactaaacagcatcagacaatacagagaaatcatttgtgcaaggaagagtcaattgatgcaccaaactttattattgttttattttaggaaattgccaccgccacttcaactttcagcaaccaccgccctgatcagtcaatagccattaacgtcaaggcgagatcccctaccagccaaaatattatgactcattgatggttcagatgatcattaacattctttagcaataaagtattttttaactaaggtatatacatttttttagacttgctattgaatacttaatagactacaatacagtgtaaacataaattttgtatgcactgggaaaccaaaaaatttgtgtgactttctgtattgtgatatttgctttattgtggtggtctcaaaccaagctcacaatatctctgagttatccctgtacattcttattcactcttagaattgagtactattggcatgatcaaaatatttttagatgaaagcttaatgcttcttgtaaacagtgctgaaactttagcatgcattggaatcacctaaaggactaattaaaacagaatgctgggccccacctccagagtttctaatacagtaggactgaggtggggcccaagagtctgcatttctaaaaaaattccaggtgggagggaccacactttcagaaccactgttgcagatcatttgatgatgtatatttccaaaatcaaagctgacagggcttgtcatacctactcaagaatagcatgtatgctgcttagaagatggtaagtcattgtcaaagccagagggatactaatgatgacttagagtttcacaggttcttaattgaccattttcattcaccttggctgatgcctagtgttacttaatgcttagtaagaaatctttaggccaggggcggtggctcacccctataatcccaaactttgggaggcagaggccggcggatcagctgaagtaaggagttccagaccagcctggccaatgtggtgaaaccccatctctattaaaaagtacaaaaattagccaggcgtgctggcgcgtgcctataacccctgttactctggaggctggggctggagaattgcttgaacctgggaggcagaggttgcagtgagcggagatcatgccactgcattccagcctgggcaacaggagtgaaactctgtctcaaaaaaaaaaaaaaaaaaaatctttaagcaatgtcttggccctaagaatataatctaaaatatgttcttatgtttatatcatcttcgatagctgattaaagtgatgtagcaactgagaatttcaattgttgatttaaatcatggaatatacaaaaagatataatccttgttaggtcctgcatactttctaaagccattatgaggtcttaattaaaagaaacaaagaataaaaccctcattttttccctagcccttactctgcttattgtttaaacataattataaagactctgaataacaaaaatttaactggaaagatgaaatcagtattcttaatactacttagtggcttttaggtttaggacatatgtttaatatgtattctgttgatttttcaatagatcatgttaattaacatgtctcaattacctattgaataatgtctctaaaatgcctatctgtgattattattcatgagattacactcccattttaccagtactatgcctatctgtgattattattcatgagactacactcccatttgaggagtacttttcttttcttttttttttttttaaagatggggtcttactctgtcacccaagctggagtgcagtggcacgaaatcggctcactgcaacctccgcctcctgggttcaagcgattctcctgccttagcctcccgagtagctgtgattacgggcacctaccaccacacctggctaatttttgtatatttagtagagacggagtttcaccattttggccaggctagtcttgaactcctgaccttgtgatctacctgcctcggcctcccaaagtgctgggattacaggtgtgagccactgcgcccagcttgagcagtacttttcaactctgagaagataaacccaagggattctagaagagggtctgcttggagaataatttctccagtaatggtatctgaaggttgaataaaaacaagtgaatagatgtagatattgactaagagtgactaagaaagacagttaccttattaattaatacaatcttgagtgtcatcaaattagctatggggcatatatcctacactcagaaattaggcactattaaagttaaagggggccacactgaattgaaagaggcaagaatttaacaaacaaaatgataaactacaaaaggtaactaaataaacagagcagcttcttatatattctccaataaggcattgtggaaacattgagggatggagggatacccaagccaagatgggtattagactgctaactttgacattaaacactgagaaattcttgagcagggagcttcctttgtatgagtctcatcttcatcacctttaagaagcaattaatgaaatctagtctgcttacttcgcaatgttttgagcattaaatttaattatatacaaatatgtacttttggtgtctgttcagtgagaattgattctcacttccctaaaagtaatttaaacgttttaatcaaatgtgtaatgttgacatctttacctttccaagtacttttgtacttttccagggttaaaataacatttttgtcatttaaatgaggaaaaaatataagttttttaaaaactcaaatgtcatagctttttaactgttctaattgtgtctgctaatagaaacaagttgatgtgcaaaccacaaaataataaatatttttgcctagcttttgggaaaaagaaaagactatagtatactttaagtaagtgtaaatttagtttcattttagcaattccatagtcgaatctgtcactaagtaatcattagttaaagaaaaaaaatctagccaggcaccgtggctcacccctgtaatcccagcactttgaaaggctgaggtgggcagatcacaaggtcaggagttctagaccagcctgaccaacatggtgaaaccccgtctctactaaaaatacaaaaattagcccggcatggtggcgggtgcctgtaatcccagctactcagaaggctgaggcaggagaatcgcttgaacccaggaggcagaggttgcagtgagctgagattacaccactgcactcctgcctgggtgacagaacgagactctgtctcaaaaaaaaaaaagaaaaaaagaaaaagaaaagataagaaaaaaatctagtgcccagggcatgcaactatataagtaaaaattctaaaagatcatcaatgtttaagaataaaatacagtcagttatataattttaaaatatttctaatgagtgataaggaaaacttgtcaatggaatttctgaagtcaatagccaatttttaactttatctgctaatatggcaattatttaacttaaaaaacagacacacttcttattcagtttttggacatcttattctgtaacttcctattgattaacatcgcctttaacattttaagtacttgtcgtaacattttatcatttgaataattcatattgtattatactcttcacttttataggaacaatcatcaaccaacattttaacctattaatctaaactaaattttttcctctcatttaatctatcaattaagattcttctgattgtatgtaacagaaaatgtagttcatttattatctcacattagaggaagtctagtggtagggcaggccccagagttggtttatttgttagcttaattatgtattaaaggacttggcttcttcgagtcactactttgccattcttagtattgtcttttctcaggggaagggtagaaggagggataaaaaggtggctgctgtacttccaagcattcagaatcattgaaaagtcttgctaaatcagactgctgcatctaatccccagaatttgattcagtaggactcgccggagtgtgagaatttgcatttctaataaattcccaggtgatgctgatgctgctcatagtaaagccacactgagaaatattaacttagactaatgatcttggaaacgaatggattttttcttttctttttagttcacatgtaatagttgtatttatttatgcaacacagaatgatattttgatacatctgtactatgtgtaatcatcaagtaagggcaattagcatatccctcacctcaaaaatttatgatttctttttgttgggaacattccaaatcctctcttccagttttttaaaaatatgcagtaaattgttgttaactatactcatcccacagtgctataaaacactgtaatgtatttctcctatctagctgtaattttgtatccattaaccaacctctccctattcctcccctccaactacatttaccagcctctagtaaccactattctactatttacttctatgagttcaacttttgagctcatgtatgggtgtgaacatgtgttatttatctttttgtgccttatttatttcacttaacataacatcctccaggttcatccatgttgccatgaatgacaggacttaattcttatttataactgaatcgttttctattgtgtatatataccacattttctctatccagtcatctgttgatggacttgtagtttgattccattatcttggctattgtggataatgctacaataaacatgggggtgtagatacctcttcaatatactgatttgcttttctttggataggtacccggtagtgctgaatcacatgatagttctatttttagttttttgaggaacctccatactgttttccataacggctgtacaaatttacaatcacactaatactgtatgagtttcccttcttctgtatcctcactggcatttgttagtttttgtctttttgacaatagtcattctaacaagtgtgaggtgatatctcatcgtggttttgatttgcatttctctgatgattagtgatgtcgagtgttttttttttttatgtacttgttggccatttgctttgagaagtgtctttagatcatttgcccatttttaaatcaaaatatttgagttttttttggagttattttttgagctgttggtttttttcagttccttgtatatcctggatattttgtcaggtaaatagtttgcaaatatttatttccattctacaggttgtctcttcattttgttgatgatactctttgttgtgcagaggcttttagtttgatatagtaccacttgtctatttttatttttgttccctgtactcttgaagtcttacccataaaattttttcctagaccaatgtccagaagcattttccctgttttcttctagtagttttagggctttgtgtcttacatttaattatttaatccatattgggttcatttttatatatgctgagagttaggggtctaatttaattcttctttaatatgaatatccagttttcccaacaccatttattgaaaaggatgttctttcactagtgtatgttcttgtcttcttttctgaaaattagttggctgtaaatagttggattcatttctaggtcctctattctgttctatttgtccttgtttctgtttttatcttgctgttttggtcactaaaattttgtagtgtattttgaagccagatacagtgatgcatccaggtttgttctttttgcttaggattgctttggttcctcaggatcttttgtgtttccacatgaattttaagactgttttttctatttctatgaagaatgtcgttggtattttaattggaaatgcattgaatctgtagcttgagtaatatggtcattttaacaatactaattctttcaattcatgagcataggatgtctttccattgtttttgtgtcctctactatttgtttcatcagcattttatagttttcattgtagaggtctttcacctccttggttaaatttattactaggggttttttgtagctagtataaatggaattgctttcttgatttctttttattgttgttgttattggcatacagaaatgctactgatttttgtatgttgattttgtttcctacaagtttactgaatttgtttattcgttctaaaagtactttggtggagtatttaggtttttctgtatataagatcatgttatctgcaaacagggacaatttgacttcctgtttttgaatttggatgctgtttatttatttctcttgcctaatctattttgtctgatataagtatagctactcctatatacttttggttttcatttgtgtggaatacatttttccattccttcactcacagtctttgtctgtttttaaaggtgacaagagtttcttgtaggcagcataaagttgggttttgtttttgcttattcattcagccagtctttatctttcaattggggggatttaaaatgtttaaaagaaactaccatcagagtgaacaggcaacctacagaatgggagaaaatttttacaatctacccatctgacaaagggctaatatccagaatctaccaaggacttaaacaaatttacaagaaaaaatcaaacaaccccatcaaagagtgggcaaaggatatgaacagacacttctcaaaagaagacatttatgcagccgacagacccatgaaaaaatgctcatcatcactggacatcagagaaatgcaaatcaaaaccacaatgagataccatctcacaccagttagaacgggatcattaaaaagttaggaaacaacaggtgctggagaggatgtggagaaacaggaacacttttacactgttggtgggactgtaaactagttcaaccattgtggaagtcagtgtggcgattcctcagggatctagaactagaaatatcatttgacctagccatcccattactgggtatatatccaaaggattataaatcatgctgctgtaaagacacatgcacgtgtatgtttattgcggcactattcacaatagcaaagacttggaaccaacccaaatgtccaacagtgatagactggattaagaaaatgtggcacatatacaccatggaatattatgtagccataaaaaaggatgagctcatgtcctttgtagggacatggatgaagctggacaccatcattctgagcaaactatcacaaggacacaaaaccaaacactgcatgttctcactcatgggtgggaattgaacaatgagaacacttggacacagagtggggaacatcacacactggggcctgtcgtggggtggggggaggggggagggatagcattaggagatatacttaatgtaaatgacgagttaatgggtgcagcacaccaagatggcacatgtatacatatgtaacaaacctgcaggttttgcacatgtaccctagaacttaaagtataataaaaaaatcataaaatgtttagccctaaggttgctattaataaatgagaatttacttctgtcattttgttaattgttttcggaatgttttgtgtaccctttgtttctttttgtttttctttgcagtttaatgattttctgtagtgataatgtttagttcctttttctgtcttatttttgtatctgttctaccagtgaattttacactattgtgtgttttcttgatggtaaatatgacattgtcctttagcttccaaatgtgggactttcttaagcattttttggaggggtattgatgagtttcctgtttttggtttctggaaaatactttatttctccttcatttctgaaagttagctttgctgggtatagtattcttgcctgacaatttctttctttcagcactttgaatatattatcccattctctcctggcctataaggtttctgctgagaaatatgctattattctgatggggattcctttagatatgacttgatgcttatctcttgctgttttcagaattctttcttcaacttttggcaatgtaactataatgcatttcaaatagaacctttttgtgttgaatttatttggagatctttgagcttccagtatctggatgtctatatcactcctaaaatttgggaatttttcagctattattttattaaattacatttctttctgttgggaccattcaacatacactttctagctatttgaaactatataagtattgtttatttcatacattgggttcttcagttttaatatatatatattttttgacagagtctcactctgttgcccaggctggatgcaatggcacaatcttggcttactgctacctctgcctcctgggtcccagttcaagcaattctccttcctcagcctcctgagtagctgggattacaggcacatgccaccatgcacagctaatttttgtatttttattttttaatagaggcagcgtttctccatgttggccaggctagtcttgaactcctgacctcgtgatccacctgcctcagcctcccaaagtgctgggattacaggtgtgaatcaccatgcctggctgatatttctgtttttttctctttttttaatgaaatgtacctctgttgaatttttcattcagatcctgaattgttttcttgattttattgtattgtttatctgtatttgtttgcatttcactgagttttctgaagataattattttgaatttcttttcaagcatttcatgcatttccttttttggtattctgctactgaagaattaccgttgttttttggtgctgttatatttccttgctttttcatgttattttgtttctctatgttaatatctgtgcatctggtgtaaccgttgttttcttccaattttatacagtatctttcatagaaaaagactttttcctatagatgtattcataatgtaagttgggtagagtgctttggctttcattctgggtgggtgcgatagtacagtctctgtataatttctttggctgtcatcaacatcagtggtgtctgcaagttcctcagtggcttagattgcagttgtctgtgggaaagctgtgctggatggggatgccaggtgagatgatccttgggcccctgggcagcacatgggtgcatgatgacctcatcgctggaatgggctgggttgctggcagaagtgatagtgaaccctcatgtggtctggtcctttaacccctatttggtgtggtggtggcagcaggtacctaggaggagtgcaaaggtgttcatggtggctgggaatggatgtttgaggattacttatgacattcattaaaagatatactataattatcatttggaaaattacagagttccctttactcacctcaaagggcctggtgtcatttttagtttgtaagcctcctgttaaatattctacactgggacactgctcatttaaaataccaatatttctagtagttgatgtagtagttttgcagaaaatagttttgcattcagatgtttgaattgggagcttgattgggtcagttcaagccccaaattttcacctcagcttacctgttcccactcataggaagttttacccctccaaatcctcatttttccaattcgcctaaatattggacatttagaactattaaaaacttaaaatatgatacaggctacaaaagcattaccttctataatcaaggaagaaaaataaggttgtccaaaggcatactgtaaatgcttctaatccaattttccacctgatctttgattgtagcaataaattttctaagctaaaggattaacaatttgcttgtgttgcaaaaactctttcctgccaatttgtaattacccttctctatcatttatctcataaactatattgccaaattgtaatttcccctttttcattatctatttcaaaaaccatctcattgatatgggttctgtatctcccatagtatgctcagtgggactagtggtctgtttggatgattgtcctgggctaaactgcaggatcctcataaagccttggggctgtttatctcactctccaatttattatcataatggcattttgtgcctttttcctcatttatttgcacaataggaagcacagtggagagagatgatttctgcagggggcctggaaggacaggggacaagttcagacacagaagaaagctttgcagaaaatatctgacttccagcagttactgggatagaaaacttttaagtgcaaaatgtactattttggaggtatgaggaaatgctacctttcccaaagcactcccacatcccagtgtgcagcaggataaagagagactgaaaatgtttctgatatgaaattgatacagcatttaaatggagggaggaggcctaggctattaatgcaaacacagctagaggcctgcagatatgacacagaatttttcccacagttttaatttaaaacaaccaacccgtcagcaaagctttcaaagttggtggaagatattggccagtggcaatttaacttactcacctattttaagacctccttttctttttcttcttcttcttctcctcctcctcctcctccccctcccccttcccctcctttgtctctctctcatccaggctggagcgcagtggtgtgaacatggctcaccacagccttgtcctcctgggctcaagcagtcctcccacctcagcctcccaagttgctgggaccacaggtgcacaccaccatgcccagctagtttttaagttttttgtagagatgacgtttctccatgttttccatgttattacttctatttctttgaggaaagtcattggcattttggtagagattgcattcaatcagtagattgctttgggtagcatggacatttaaaaatattaattcttgcattccatgaatatagaatatgtttacattgttttgcatcctcttcaattgctttcatcagtgttttacagttttcatcatagagatgtttcacttctttggttaagttaatttctagggatttaattttatttgtggctattacatgtgggattatttttacctctttttcatattgtactctgttggcatatagaaatgctactgatttttgtatgttgattttgtgtcctgcaactttattgactttatttaccagttctaatagtttttggtggagtctttaggtttttccaatatatagtcatatcatctgcaaataaaaataatgaaacttcttcttttacaatttagatgttaaagaacatttctcttgcctaattgctctagttaggacttccagtactatgttgaataatagtggtgaaaaagtgggcatccttttcatgttccagtcttaaaataatgactctaagtttttccccattcagggtaatactagctgtgtgtctgtcatatacttttttctttcttctttttttttttttctcactctgttgcccaggctggaatgcagtggcgcgaccttggatcactacaacctccacctcctgggttgaagtgattctcttgcctcttgtaatcccaagtaactgggattacaggcatgcaccaccacacctggctaattttttatatttttagtagagatgaggtttcaccatgttggccaggctgatctcaaactcctgacctcaagtgatctgcttgtcttggcatcccaaagtgctgggattacagacgtgagccaccatgcccagcacaacttttattatgttgagatatgttccttctctacctagtttttaaagggttttaatcatgaacagatgttaaattttatcaagtggtttttcagcatcaattgaagtgatcatatggtttttgtccttcattctgttgctatgacatatcacattaattgatttgcatgtgttgaaccatccttgcatcccaaggataagctcacttggtcatgatgaatgatgtctttaatgtattgttgaatttggtttgctagtatttcattgaggatttttgcattaatatttatcagagacaccagcctgtagatttttttttgatgtgtctttgttctttgtatcagggtaacacttgcctcgtagaatgagtttggaagtattccctcctcctctattttttgtaatagtttgagtagcattggtattagttcacctttaaatgtttggtagaattcagcagtgaagccatcaggtcccaagcttttctttgctggaagactttttattatggcttcaatcttgttacttgttactgttcaggctttggatttcttcatggttcaatcttggtaggttgttatgtgtctaggaatttacccatttcttctaaattttccaatttattagcatatggttgatgatactagccactaatgatcctttgaatttctgtagtatcagttgcaatgtttctattttcatctctgattttatttatttgggtcttttccttttttttctttgttagtctggctaatggtttgtcagttttgttcatcttttcaaaagactaactttttgtttcattgacatttttattgttttcttcatttcaaacttatttctgctctgatctttattacttcttttttcctactaattttgagtttgatgtgctattgcttttctaatttttttaaagatgtatcattaggatatttatttgaagtctttcttctccttcttttttttttttctccacagagttttgctctgtcacctaggctggagtgcagcctagctcactgcaacatctgcctcccaggctcatgcaattcttctgcctcagcctcccaaatagctgggattgtaggcacctgccacgacgcccagctaacttttgtctctttagtagagacagggtttcgccatgttgtccaggctggtctcaaactcctgacctaacctcaagtgatctgcccaccctggcctcccaaagtgccgggatcactcatgtgagctgccgcacccaaccctctttcttctttctgatgtaggtacttagagcttaaacttccctcttagtagttatagctataaacttccctctttcaatgtatctgatatgttttggtatgttgtgtttccattagcatttgtttcaagaaatttttcaatttctttcttaatttcttttctttctttctttctttttcttttcttcttttttttttttttttgatagagtctttctctgtcacccaggctggactgcagtggtgtcatctcatctcactgcaacctccgcctctcgggttcaagtaattctcccacctcagcctcccgagtagctggattacaggctctggccaccatgcctggctaatttttgtacttttagtagagagggggtttcacgacattggccaggctggtctccaactcctgacctcaggtgatctgcccacctcggcctcccaaagtgctgagattacaggcgtgagccactgtgcccgttctccttcttaatttcttcattgacccactggtcattcaggagcatattgttgaatttccacgtatctgtatagttttcaaaattcctcgttattaatttctagttttattccattgtggtcagagaagatgcttgatattatttcatttttggggaacgtttaagacttcttttgtgacctaacatatggtctgtccctgagactactccatgtgttgagtagaagaatgtgtaatctgcagccattggatgaaatgttctgtaaatatctattaggtccacttggtctacagtgcagattaaatttgatgtttgttgattttctgtctaggaggtctgtccaatgctgaaaatggagtgtttaagtccccagctattttgtattgaggtctatctctctctttagctctaataaaattagctttatatatctgggtgctccagtgttaggtacatacatatttataattgttatatcctcttgctgaattgacctctttatcattatatgatgaccttctttgtctcttcttatagtttttgtcaagaaaactattttgtctgatataagcatagctactcctgctcttttttggcttccattggcttggaatatctttttccatccttttattttcagcctatgtgtatcttaataggtgaagtgtgtttcttttctttcttttctttcttttttttttttttttttttaagacggagtcttgctcttgtcgcccaggctggagtacaatggcgcgattttggctcattgcaacctccgcctcctgggttcaagcgattctcctgcctcagcctctggagtagctgggattacaggcacctgcgacaacgcccagctaatttttgtatttttagtagagacggggtttcaccatgttggccaggctggtctcaaacttctgacctcaggtgatccacccgcctctgcctcccaaagtgctgggattacaggcaggagccaccacgcacagccggtgaagtgtgtttcttataggtgatagatcactgggtcttgttttttaatctattcagccactctgtgtcttttggttggacagtttagtccatttgcacttaatgttattattgataagtagagactttctcttactattttgttatgtgttttctagttgttttgtggtcttctcttccttctttccttccttctgtcttcctcttagtgaaggtgattttctctggtggtatgatttaatttcttgcttcttatagttttcgtgtctattgtacgtttttcaagatgaggcttgcaaatactatcttataacccattattttaaacttaagacaacttaaaactgattgcataaacaaaaacacattaaaaaaaagaaaactaatagaaactctacactttaactttgtccccctgctttttaacgtcttgtttctctttgtttcattgtactatgtcttgaaaagttgtcgttatcatttttggttggttcaccatttagactttctacttgagtactctacatgccacaattacagtttgtttttgcaatcagttataatattctctgattttctatgtgcttactattaccagcgagtttgtacatatatatgtattttaatttttatattagatttgggggtacacgtgaaggtttgttacatagataaacacgtcatgagggtttgttgtaaatattcatatagatgatttcttattgctcattaacatctttgtctttcaggttgaagaactctgtttaacatttattttaggacaaatctagcattgatgaaatccctcagcttttgtttgtctgggaaggtctttgttcttcatgcttgaaggatattttcaccagatatactattctacaataaattttatttttttcctttagcactttaaatatgtcacaccactctctcggcctgtaagattgccactgaaaagtctgctgccagacatttgggagctccattttattttatttgtttcctttctcttgctgcttttaggatcctttctttacccttgacttttgggagtctgatatattaaataccttgggggtagtctttgggttaaatctgcttggtgttctacagtcttttagtacttgagtgttgatatctttctccaggcttaggaagttttctggtatcatccctttgaataaactttccatccccatctttttctctacgtcctctttaaagccaataatttaagagttattgcccttttaaggctattttctagatcttatagccatgcttcattcttttttatccttatttcttttgtcttctctgaccatgtattttcaaatagcctttctacatgttcactatttattttttctgcttgatcaattctgctattaagagactctgatgcattctttagtattccagttgcatttttcaactctagaagttttgcttctttttaactatttcaatttgtttgttaaatttatctgataaaattctgaatttcttttctgttatcttgaatttctttgagttttctaaaaagagctattttgaattctctgtctgaaaggtcacatatctctgtttctcctggattgatccctggtgtcttatttagttcatttagtgaggtcatgttttcctggatggtcttgatgtttattggtgtctaagcattgaaatgttaggtatttattgtagtcttcacagtctggacttgtttgtgcccatcctccttgggaaggtttttcaggtatttgaaagaactagggtattgtggtctaagccatagctgcgtgagggggcacctcaagcctagtaaggttgtggttcttgtagacttgtagaggtactgccttggtggtcttggataaaaccctgaagaattctctgtattatgaggcagagactcttgttctttacccttactttttcccaaacaaatgaagtctctctgtgctgagctgcctagggctgcaggtagagtgacatactacccccctggccctcactactgggactgtgctgggtcagacctgaagccagcacagcactaggtcttgcccatggctttctgtaaccactacctgggtaccacccatgttcactcaagtccctagggctctaccattagcaggtggtgaagccagccaggttggtgtctttcccttcagggcagtgagttccccacagccccgggtgggtccagagatggtgtatgggagctagggactgcagtcaaaaatccttgtatgtctacctgacgttttattctactgtagctaagctggcacttaaaccacaatacaaagtccttcctgctcttccctcccctttccacaggcagaggagcctctccctgtggcaaccactatcactgggccatgggtggttttctacaccaccattggtattcacttaaagttcaaaggatcttcagtcagcttgtggtgaatgctgccaggcttggacatacccttcagggcactgggcttccctctggcccagggaaggtcatgaaatgccatccaagaggttaggcctgggattggggacttcacgagcccacttgttggtctaacccactctgactgagctggtatctaaagtgcaaaactaagtcctctttactttcccctctgcttttctctagcaagaggagtctctcaccatagccaccacagctggcaatgttctgggtctcacttgaagacacgtctcagagtctcacccaaggcccatgccatgatgcactacctgggtattgcggctgattatttagtacccaaaggctctttattcacaggtgatgaatcctgccaggtgtggatccttcccttcgaggcagcggtttaccttttggcccatggtgtgtctagacgtgtcatctatgagttagggtctagcatgggggcctcatgactgcccagtgccatatcctactgtgactgagctggtatgcaagatgcaaaacaaagtcttctttgctctcctcttcatacgcagaggagtcacttttgttgcttcaagctgtgctgcctggggttgggggaaggatggcacaagcactcccttagattccctggctagtgtctccccaggtcatgtaccaccctagtccagtggctctaagcccatcccagcccagcactagaagttgcctaagaactgcaatccctgtgtcctagacagactttcaagtttacctagaaccccagagcactttggcctatggtggtgaggcttgccaaaaaactcaagttctgacaattgggatggtccattcccctctggctaggtctggtccaaatgttcccttcatgcatgagtgctggctgagcccagcatggctttgctctccactgtgacatggcagcactgagttcaatagaaagaccactagccactgcactctccctcccccaagtgcatatactctctgtgtagcagggctgctgctaggttatggggaaggggtggtgtctgtgattcaagactgtctctcctactctcttcaatgattctttcagtgatatgaatataaaaccaggtactccgattgctctgatttttggttcttgtgatggtatgcagttagttgttaaactttccagtatgcagatatttgttaaaatgtgttgttcctgtcgggggttatcaatggtacaggcttctattccgccatcttgctctgctctccaaaacacttcgaatattaaacactgaaataaatgtgagttatacatacatttaagaaagattaataaaacaaataaggtaattatttacccaattattccagttccgggttgtaggtggctggagcctatccagcggctcagcactcaagggaggaatcaaccctggacaggatgccattctattgcagggtacacatgtacacacactcactcacactgggacaatttagacacgccaattaacctaacatgcacaactttgggatatgagaggaaaccagaatacctggagaaaacccatgtagacacagggagaatgtgcaaactcaatacagtggccctaccagtaattgatgtttttttctcatcatttaatgaaatgatgttgaacaaaatgaccttattcgaggacctagtgtacaatgctttttgtcaggcattaatattcatgccatcaaaatcaaaagcacaggctcagctaaaatttctcaaatgcatggaaacaagcacctcaacactgttatcttttaatttcaaatggttacctgggctcaaaatctgggtgtgcaattttatctgctctgggcagtgctcaatatcgagcatttcttacaacaattaggacttattcccattcagataatgttgtcctagttaacccctttgtggtttttggagatgtaggtttattctttaaactttttttttttttttttttttttttgagacagtttcttgctctgtcccccaggctggagtgcagtggcatgattacagctcactgcagctttgacctcctgggcttaagcaatcttcccaccccagctgcctgagtatcagggaccacaggtgtgtgccactgcacccagctaatgcttttattttctgtaaagacaggatctcactatgtggtcaagcctggtcttgaactcctgggctcacacaattttcctgcctcagcctcccaaaatgttgggattacaggtgtgagatgcaccagaaacccttaaacttcttaaaaatcccttaagtcctcttggttttacaggaaagtaggagcttggattttagtttgatcataggaaacaagtagattgttattcattcaacaaaaaatatttatgataaacatttttcaggctatccatttatttaataggtctttattacatatttactgctgtcaaatgttttggggccagaggtgaattatgctagtttggaaactaggtggaatattatcatttaaatggatacctttgtatctcaaaacaaatcctgtagtttatataatttggaatattgtatgtctgttttccatggaaatgatgaagttcattggtcatggtactcttgggtcatgggactcacactcactttgctcttacctctttcttattttcacatgcatcccatcgacactcatgtctaatccagaagactggtagtatataagatcccaaatattaccactggctcagaatctgagccaatgaatggagagactatgtcatacttgaaataaacttctttaacaataaaaattaagagtataagttctctcatttcatctcagtttcatcaaatatttcatgtttaaaatgctagcaagtgtgaaagaggctatggaattttgtgagtgataaaatatttgtagagtacttggggatctggatctgggtgctattaaaaccaaccaaacacaagtagctcatatgagtccttcaatttttattcttgcttccaacttttaatcttccagcactgccaaaacatggaactaggcagatttatagcaattctggtagatgtttgttaggaactgatttcgtacaacactcttggcaataaaactatagttttctaaacttgacatttagcatgtcctttatcttataagaagaaaaatacttctgttgttctgttggagtaggttagcttataaaaataaagtgatgcatctttatatgtttttaacgtgtccaactttgccaggcatggtggttcatgcctctaatcccaagcacattggtaggccgaggcaagaggatctcttgagcctaggagttcaagactgcagtgtgctatgatggcatcattgcactccagcctcagcgacagagactctgtctcttaagttagtaagtaaataaataaaatgttcaacttaaaataaaattacaatttcttttctagcagctaggtgaaatttcttaactattaacctctggtactttaaacaacattaaaacagcctttaaaagaagacattaattaattgaggaaagattttaaaataattttttccaagttttaatttttaaatccctaaagaaccacatattcttgtaccatccaggtttataaaaatgcagctatcaaatttgatattaaaaacaagataccgcacaccctttgtggaataaagcacagtataaagaaaattagaatgtcatgaccattcttcttcaatctttcccatttgtaatatttcccccaagcggaaaagcctgacaaatttccctttcttgcacgtgaccactttttgcatcagatgcatttaattttgtaggttaaatattcaggacaaaaggagagtagaaagaatttttagagctttgatttctatggaagcaataagctgaaacttggaaataatatgtttcattgccatcaatcccattgtagctagctaacactccagggatttccttgattctctctataataatcttatacttctatagtgcttataatttgcaacctgtgttcacttactttatgagattcttacaaaaatcttttgaaagaaggctagtgtgtatgtatatgtgggtgtatgaatatacatatatatgtgtatatgtttgtctatacatatacatatgtgtgtgtatgacatatatatgtatatagtcatccctcattgtccacaggggatcggttccagaaccccctcagacaccaaaatttccagatgcttaagttttttatataaaatgactaattggtcaattcttcttggtaaagttgatcttgatcttaccagtttcttttttggcttagtaataggaacaatgattttcataatttaggggaccaaaagtaaaatttcagtttaagtcattttaggaataaaccatggagctataaatcttttggaggagttatagattcagtgttaatgctagagtattgcagtatattaatacaacagatagttctgaaaagttgctttagaaaaatgtttcagctaaagtgacccaataccaaattctgtacagttaccctctattttgtaaatgcatatgttaatatcaaagtatttatattgtgtaatttcctaccttaggtgcttttgtttttaatataatgctgtttcaaggtcgaatatgtacagtaataactgttacaaattgattacgagagatcacaatcattgtacaaatcacaggctatgtcattgtgtagacaaaaatcactgaccatgcatgccagaggtggatcataaatagtaactcctaagactagaaatctacttgatatttttatgggttcatctttaaaagtgacctcgctgaataaaagttcaatatttcttaaaagaaaggtaaatctaaaaaccgtccagaattttcgatcctagtctagtaccacttacttgggaacaaatatagaagcacaggcaaccccgtccgttaatttggctccgtcattgtgcagacaaaaatcactgaccatgcatgccagaggtggatcatagttaactcgttaagactagaaatctacttgatagtgatttttatgggttcatctttaaaagtgacctcgctgaataaaagttcaatatttcttaaaagaaaggtaaatctagaaagctgtccagaattttcaatcctagtctagtaccacttacttgggaacaaatatagaaacacaggcaaccccgtccgttaattctgatgttgaacgtgtggttagagagcacactgcgatatgttacaggacctgagataaaaagcaaatttgtaaagtgtctaagtgttgatggagaaaaacacatctagcatatacggaaattttcttttgagttctctgtaggatgatcaccaactcagtaggtgaagccctgccctctagtggttatgggtgtgagaggacttctgttcaacattatatgtctggctcaccacggtttattaaaaccaatcgttcattaaaaagcacttattaggggtctgggtaagatgccgagcaagtgaaatgtttacgtgtgaaaaggcattgacactggacaaaggtacagctgctaaaagaagtgctcgttcattggcttcgacagctgtacgactggtttctaattgctgttccagcctctccccagttccatataccacaaacgaatgaaaaagattagctctccctggagctctctgaggctgaaccttgctctctcattacacatggtaactaagcacaccccttaaagaattttgggaagtcgccccgcgattaccggctcccccaagaaccaagcagtcagtgcagggttttgcaagtgagagtgcgagactcgggaggctgctcacggtgctccagtccctggcaggagcatggacacctcgccccttccttccgtgggcctcaacgttgcctgctgagattgtgactgccaccccgacgggagcagcttcccctacagactttgtagagagcgcttaaacgcctcggggacagcggccatgactctcagcttgggccgaccccgcggccgccccacgggaatgcgtggccgacacggggcgtgggcgaatctccgaccctcgcgttcagggggtgcatataaacgggcggacaccgtccctggggtaagggaggcgccagcaagaacaaggcgggccaccaaccccgagcgacctcctaccggacggatccaaacccaaacattgtccattccgggccgaagtctcggccttcacttcacttccgccttcccagcccgtgaacacgaatgcgcctgcgcgcacctctctcagcggaagtaatagtgacaaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggtgggtaccagtattacctcctgcccccatttctagaaacttccaggttctgaaggaaggggaggttcgggtatcccctggatgggggggcatctctagggcgccgccccgctggcgtgagctggggacgttgcgggcacacgacggggcgggtgcgggatcttggggaggggggctcccgagatagtggctgggcggggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggtaaaggcccctggccgaccggttgcaacgcggagttgagggtgtggtggtttgcttttaagttgtctttgtttttccacctttttattttcgtgagcttatttatttactgtgtatgtgaagtgtccaaggatttgcttacttagggtatccagcttttattttggtaacatggggcatttgagagattgaggttctgtgggtgactgagcttgattcagctttcttgaggaattcctgctctcttcagcttagggaatgagagggaagttttcatttcagatagcgtctgtgcatgtttaaatagctatttgaaaggaattactcgaggggaagtggaaatgggggacaaggggatggggctgcatctctgtatattggcgtttcaagcctcgatgtggtgtgtggcaggattcatttataagaaagcaagccatgttttattatgtctagcattggggaaaaaactcattatttttcaattcacaaaaaaaacccagtgaatttaatgaaatgttatgagatgagtgcttttcttaaagttccaccctatttcaaaacatcatttaggaggctgacagcggaacctgtttgttcactgtacactttggacacattagatcgtcattcacatgttacatgatccctttggcctcgttaaaatatttaatgcttttcctacacagcactgattatttttaaaattgttgaacaactgtgaataagtgattttttttccccctcctgaaacaacacttattctttggactgacttctgacttgtgcgtgatcatttttttttcttctgcctttaaccgggctgcaaaatactataaaagatacttaacaaatgacagttttttcctctggtataatttgttttaaaaaatatgtgtctggtataaaggagctgcagtcttgctggctgcttctaatttgtttttccattgttgagaatgtaagcttgattgtctgactaggactagtaattttgaaatgggtgtttcttatagatgcagtaatgtgttttgctctctgagacctctgggctatgtagggaatatgatgagaggcatgattatattgacaaattttactctggatggataattggcggaagacattttctgaaatactaaagtgtataactgcagaggagttatactgtctaattgggtcttgagaaacatttgaaagcagtgatgtttttggtgataaggaaagtcacttttctgagcctttttcctctcttttaagtttattgatttaagaaaggcaaatccattctgcacatgagacaaagaatgttaaatgcattcatatacttgtttcttggtagaaacatcttaaataacttctaacatttaatgtatgtttatgagcttgttttcagaatggtaccagatttaagagggtagcctaaagtaggtggattctttcatgttgcttttgtttcttgatctctcaggaggaagagcatgagtaataaagccgattctcattatctactgaggtgggagggggtggttgtgagataggagaatggtgcctacttgtgtctgtctctgtattttgtggccaaatatgaattttgtggtttcatagtaaaagattatacagttcttaaaaacgtgtggggttttctgtcccgttattcttgaccatcaagagaccatttttgtcagtttctccctatcgtcacatttttttttatatataaacagtttgaagaagagcctgtatatagcctagaaattttcaaaagtgactgaccatattaaactacatagattgatacctgtgcctttttattgttcacttgcctttttgtagttttcatccttctttgatatagtgtagtattaacaatttggaggtgtgaaacaaaaatggattcaagtcttgactaacttgtcttgaaccacttaaagctgtgtgattttaagtaaattacgtcacctttctgagcctgtatttcttcatctataaattgggattgataatctttaactcacagaattgagaggattaaatgagaaaccctgtataaattctcttgtgaggtaggaatgataacgtttaagagcttgagttgtggtggaaccatgcagactgatttgaatgctggattcgtcgcttaccatttggctttgtgcatattaaagttttctgtgcttccgtttcttcataaaataaagataatgatagaacctaccttatgaggttgttgtaaacattcaaacagtatctggcacatagtaagtgctcggtaaatgttaattataaattgcctagctgaatgtttgatacatactaataggccacctggcattaatattgtcatgacagttaaatgttggaagggggaacagtagtagccaaatgctcaaaatgaagttgtcattgttagttgagggataagtggagttaggtaaggaattttctatggcattagtgcttttaagcctacagaaaaagttagggctctaccaagaagccagggtccagtacagaaagagacaggtttggatttgaagcccgacaagtaatgttttcctctcctgaaaaatctgacaagttactaggcttctaagctttctcagcctctaagttatctcatctgtaaatgagataatgccctcttgcaaagttgatgtgagtaataaatgaagccgccagagcaatgtttgacatacagttaacttggatgaattgagtgatgctgctgttccctagtaagagtatcctccagtaggtatgcaggtagttacatttgtgggtgtgaacagtgtagaattgatagtgtttccctagagcatcagcatgaaggtttcttaggtagcttacagtggtgtggggaggaaatggtttcatccatgtgttggttccttcagcaatggtggtattttctttggcacttcggtttagattcttctggacttttttcctagggcccatttaaactttctcagcaaagcttgaccaatttttagctgtagactccaggatgtttcatgaacactttctgcttgtcactaggaacgtttaaaatgttaatttcctggaatttttggactacttaacattcagtcgtgagttaggattttatccagatcctttggaatttgtttttacatgtttatcacaaatctaaacagatcccgcttaggcatcttgagatgcacaagtaaacagctcttacctgatttttaaaagttaattgcatgtttaaagtgatagcttactagaaaagatatgtctagctggagaagcttgcacataggttttcctttctagtaatggatttattttttggaataaatttggcctttcccatagaaaattcagtgtgactttaatacacatgaaactttaatatagccttaaatgtttgactagtggatagaaatgtaatagtcttcaggatttcaggacatggttaatttaagattatagacagagctaataggtgtagagaacaatgccccaatcttttttgtttgaaaatggttgtatttacactttacttttaaaagcagtttcttaattcaatttcaaattgttaatcagctaggaatgtctcaagaaaaaattgcattactatagttggagaagctatagggaaaaagggatgagaagccaccttaattttattcctttaactgaaaataggaaaccaggttataaaaatatatctttgggtgtgggaaatatagtttatgttgtttgcagttttgtccataaaatgatagtcttaattagtactctgaaaaagagttgaaactaaaagagattatatatatgacattttgtaaactgtagtaatttaagccagaggatgctgtagagagtacttgtatgcaataaccttctgacagttggattccaaatacttgatttgtcttcatatttttgtcattcatttaaagtcagcagaattcaggtctgttaacgcaaagcattatgaaacaaaatagtttcctagggaacacacccctaggggcccaggactgattttggagatcttagttagccatgatctgttttgcaaggttaaattttgttttaaaggtgccaggaacactgtggcttgatggtaaagttagcatgaattttaaattacaccgttgttacatgtagcatcttaaaatatcttaaggatcagttcaagaggtcccctcacatttactttgttgaaacaaattctttttaataatggtttcaggcatcagttgtgacaaggttatctttatgcttttcatgtagacaaatgttggtaaaaggcagtaaagggtgcatcctgaggttaatgccatcatttcatgaaagaaaggatctctcaaaaaaaaggctaaattgataatttcctcttggatgtatatgactgctacttatatgcatttgttaatacagttgacccttgaacaatgtgggggttggggtgctgacccaccatgcagttgaaaatctgcatgtaacttttaactctctgaaaactaaactactaatagtctctactgttgcctggaagcctcactgataacataaacagtcaattaacacatactttgtatgctatatgtattatatactgtattcttgcaataaagtagagaaaaaaacttaccaagaaaattatgaggaggagaaaatatatttataattcattaagcagaagtggatcactataaaggtcttcatcctcattgtcttcgctttgagtaggctgaagaaaaggaggggttggtcttgctgtctcgggtgacagaagcaaatctgagtataagtagacctttacagttgaaactcatgttgttaaagagtcaactgtgtatcttctgtcttcaggctttaagttgctacgacaaaagtataaatcgtagaattacaaataaattacaccaattgtgttaaattaggttggtttagactaaacctgtgatgtgtttagaaaaagtttgaatgaaatgttgaaaagctgtcctagattatagacagaagacagtaatagtcggggtcagaagcattatcttaagatggccgtaactgggtgtctgattcaatttctatctctgctttttttaattctgctataggtattagagaatgtgtgaattggaattatttaatatacctgttagttgtaattgctttcttaagtaaaggccttttggtttgacatttggtcatttcgtaaacatgctgacctaaactcgtgtccctccctcagaaggaaatacgttaatttagtatgacatccttttttttccctttgtgcttatttatttatttatttttttgagatggagtctcactctgtaacccaggctgggctgggacacagtagcatcattatagctcaccaaagcccctaactcctggactaatgcgatctccctgccttagcctcctgagtagctgggattataagcacacatcactatacccagctaatttcttaatttttttaaagacgaggtcttgatatattgcccatgctggtcttgaactcctggactcaagcagtcttattgccttggcctcccaaattgttggaattataggcatgagccaccgtgcccagctttagtatgacattctttattcttttagaaagctttgagatattgatgcatccttatagaaattactttcatttatttatttacttacttaaaacagcttgataaagttggaaaaagcaggaccctaaataataaatatatttgccatcagccttttataggaaaactcagaaataataagtggaaatatttaggatgtcactcatcagactttttttttgaatatgtaaatgtgtttttttgaaaatttaaacacgcaaagtaaaaattaaaagttttggttaagttgtgaatttcagaaatttatcttggttatggtgtcctgaagttaaaaagaatagagcattagtacattagtacataaacgttctgttattctctgcctaagggcaagatccaactttgaaccaggtcctggatttcctctcatcttaaatcggagcctttttcatttgtagtataaataaattagccttttgatgctgtgattttatttgtatatgttatatatgagatttatatctctctttgtatgcaggcatttcactagattttgtttggccatctatttttagtgtttccctagcagcatgtttgctttacctgccttcatctaggtttctacatcatcaggggtggaaatattagttggcttaattaagcttgggagttgtaccttacttgctctgttgagtgtcagttctaccttcttttgaagcaggcaaaagcagttcatggcacaaatgccagaaatagcatgcaaaccactttgtagtggtatgcaaactaatttctgctgtgtccttttcttaatgcttgtgagggttactgtttacttaagagttaatatttggcttatgaaactagtatcagatgagaaattccagcatccctccccaccccagagaaagatgtggtcattggggactgctctgaagtctgccagccctctatcctaaaagttggtagatcagttattatatcttgatatgtacccctaattcatatgaggggccaagagagattagttactcctgatttcatctgttagaagataaagggagtgtggtttgtatctatattagagtaatgggaatgaagggtagggatggatgacagagatattttactcctaggaaaaatcagcaggacttggacagtgactagatacagagaattaagggaatagttgaatcagacatgactgcaagatgtcatttgggtcagtgaaggtgccattgattgtggttgaaggagtgagccgatttaggggctggctgaagggaatatataggtcagactgtcatgatgtgaggctcatatagctatgcatggagagaggtgttaaatcaagcaccaggattcaaagtgagctcttgaaggcagagacctcaatttgtcctttattcatcttgaacagactctgggacgtacctactgtcaattgaatgaaaatgctggcttcttccttctaagtggttctcatctcaggattgttttgcccccgggggacatttggcaatgtttagagaaatgctgggttgtcacaactcaaagtatgctactggcatccagtgtgtagagaccagggatgctggtaagcatgctacaatccgtaagacagcatcttctacctccccccgccaccctcaaaattttttagccccagatgtcaatggtgccaagattgagaaacactgttctaacaaacggcaaggaagttgactcctctaagccttggtttcctcacttgtaaagagattatgactacttcaggtttgttagaattagaccaggcagggtgtgtacaagtgcctggcatgaaagagcctctcagcaaatcctaatttcccttaccttacttgatgaatagatttaggggagttacttttggtcttttaactgctaatttcaaggcttcacgttttttttttttgtttttttttttttttttttttttttctgagaggtgagtgggatgcctaggaaacatagagtagcttttataatcttaatgcttttctcatggttttatcaaattatgattttgattatactttggtttgggtttgtactatttcaggattcagtatttagtgttcacctagcagtagacaatgaagttaaacccttagtgtagatcaatgaagttaagcccttaaattttactttttagcctgtaaatacattttatgtattatttattgctcacagaactgttattgtttggaagcaattttactattctttgaaatcaagaccaaaatgtactgaattttatttctcatggaaaatgctagacctcctatgtctattgcctttttcctttttatccatttattctaactagaccccccccgaagtcagaactcttccttagatttcctttttagggtcttcattaggtggctttcttttgcttgtcgggtgtctttttactttattttgtaaggtgttgaatattccctttattttgtaaggtgttgaatgtttcagtggtgttagggacaggaccaccgatattttcatctctaataccaatcccttagtgatctattccagtcatagcctcagtgtttaaagtctccttacatgtacatagttgtgtggcattctcatttttagggagtcactggaattctttgctgctatttctttccttttaggaaaaaaaccggtttactcttactatacattattttctccatctatagaatggaattactgtaggtaaaagtccttgagttcggtaaactatgtattggacttactaatgtacgttttattaattgcaggtggaatttagaaataacctgcctgtttttcatcttaaactaagattatttaaatattccattcattaattagttggttagaaaaattagcttttgaggaacaccacttaaacatggaaaataataacagagtacattttgtgacagcaaataaattatcggttaacttaaccctataggattcaaagttggtagctttaaatgatattaaattgtatttgactgtcaactgcttttaaaggcttacgtggctccccattgtacctgtagttatttaggtctggaagcacagggtgttaagaatgccaccataatgtcttttcataagggtttggtttgtcatagcctgtaaaattaggttcaccagttagctgctttatgaaatgaatgtcattggtcatggtgggggaggtattaggagaaggtataaaggaatctaaaaaaactttctttctttctctccctccctcccttctttccttctgccccttcctcccccctttcctttcctttttcctctttcccctttcccatttcccctttcccctttcctttcctttcctttcctttcctttcctttccatcttctgtattgctagtaaaataattgttgctcactgaaggctttaaaaaacactggttgcatgcttaatataggatggcaacaaaatggacgggtttaaaaaatatgtagatggtatgatacccctttcctccatccttgtaccaaatttctttcaaacctagaataatttatacaaacagatgtatcagtagatggagtattatgcccactttttaatttaatgatcaaaaaatgccaaattcttcccagagtggcagtataattcagatgtagttaactgttggatgcaaattcaattatggtagaaagatttactttactttgagaggtttttctaaaatcttctaaaattatgttgatttttaaaatttgaaataactttagacttacataaaaggtataaaaatagtacaaagaggtcctggatatcttttgcccagttactcctaatgttaacatcttatataaccatagtataattattaaaaccaggacattcacatttataaactatcctttttctagttcaggatccaatttgggatcctaccttgcatttagttatcatcatgttagtctcctcccatctgttaagcttttcagtcttttttttctctcatcttttataaatgttactgacacttttgaagagtactgttagttattttttagaatgtttctcaatatggggttgtcagatcttcacccgtgattagcatgtcttatgatgggtgaagttaatgtgatcacttggttaaggctgtgtctgccagatttcttcattgtaaagttactgctttttcctttgtaataataaatgttcattttaaccttgtagttgtataataattagtaattcctttgtaattaataccttcctctagtggggaggtactgcaaatatactgtgtcccatcatacttatcatgggccagttttgcaatatcctgtgttccatcatactttacatgggcaagttttgctatctatcaatggttcttaactggcagcagttattactgctttggtctttgcttaatggcgagttttctatttcactcattcttactatatttggaattctacaattaaggaagtactgtcctctttacttattaattatccaattaatttatttacatggctttgtggatattttgccttatgggttaaaatccagtaattgttgctcaagtcattctcgctttggttattgagggcacttgaaaatttgttcctgtgtcttttctacaataccctctctcattttgtgagcactaatttactttctggtatcacatgatgttctgggtgtatcttgtatttttcctgcttgcaccagccatggaatcaaccatttttccagggagctgagttcattttactagagaatgatatctagaaaccaagatctgggtgccaggtgtgctccatgctactgggtgtcattgcttctaggctctcttagtagatagagctagcagtgtatatgtttggtaacatgtatgaacacatatgtttttattttcttatctatccatctatgtatataaataaaaaactgccagtgatgctgccagttctgttcttccaccatagggtccattttggtcttttttcctgttcagcccttttctctttctttgttacttccttctccaaaggtgagaaactgttctcaaccacagtatattgacttacttgtttcatccgagtacacacaaacaaaagtagttttagaattagtgacctattcattccctggtgagaaacacagttttaaactagagtacaatatttgtctttaactttatggtatacaggcaaattctgttttcagaagttacttgggttcttttcatccctgcctaagggttatgttagtcacttgtaataaaattaggttcacttgttattgtttgtatgctgttttaagttcctcctacatcctgtttcatcatagcacagtatccctctcccatttatttatgataaagatgtgttcttaaaaggactggatttgcttaaggttgggtacagctgtaattgctttgccagacagcagttaaaggacatgtgctttggcaatcattctcttgggcttgcttgcctggttccttagtttcagctctcatttctacatcgtttacacttgggaattgatatcagctgtggccccataactgtcagtgcttgaaatcatgcccatcgactaaatcttatttgttctgtatgcacagttttagacccggagccacctacagtatgaatactaattctctcatagctgtggtaaatcatgaagtattttgtagaccctgtcctttactgggtttttctttttcaagatagaatcacttaccacaaaatttgtcattttaaagtgtataattcagtggtttttagtatagtcacaaaattgtatattgatataattctagaacatttttatcaccccagaaagaaaccccttacccattagcagtcacttcccattctcccctttcgctagcccctggtaaccactaatctactttgtctttatggatttgcctgttctgggtatttcatataaattgaatcatacaatatgtgaccttttatgtctggcttctagcacgtgttagtacttcatttctttttgcgatgaaataatattccattgtatggatatacacattttgtttattcatcagtttctactttttgtcaaaaaataacactattgtgagcattcatgtatgggtttttgtgtaaacatgttttcagttttttcaggtgtatacttaggagtagaagtgctgggtcatggtaattctatctttaatttattgagtaactgccatagtggttgaaccattttttcattcccactagcagtgtatgaggctttcttttaattaatttctccacatcctctccaacattttgctgttttttttttttttttccattgcatcctagggggtatgaagtggtttcacattgtagttttgatttgcgtttcccaaatgactaatgatgtgtcaaggatcttttgcatggattcttcatgcaaaagaatgaaggtggactcttatctcacagcatatgcaaaaatcatttctgcactctgacttctaatctgttggtttataagtctttgcagatccaagtaccacaatgttttggttactgtagattttgcgataagttagttttgcaactaggaagtgtgatgtgcttattggttatttgtatatctttggagaaatgtctattcaaatcttttgaccattttgtaatttggttatttacttttttgttgagttgtaagagttctttatatatatgtgtgtacacacacacacacacacacacatacgtttattctggatactggataggaatatattctatacttgtaccagtatacaaagatgtttacctaagagtgttcactgcagcaatgtttataagataattatcagagatatggtttgtaaatatttctcccattctgtggattacctgttcactttctgaatggtatcctctacatcagaaacttttaaaattgtgatgaagtccaatttatatatgtgtttcttttattgtttgtgctttatatatctaggaaaccattgcctgattcaatgtgatgaagattataagaattttatagtttaactctcacgcttgatccattttgagttcatttttgcatatgatgtgacataagggcccaccttcattcttttgcatagaatatccagttatcccaatactgtttgttaaaaagactattctttttccattgaatgtcttggcacccttgtcaaaaatcaattgaccagaaattatgggtttatttctagactctgaattctattctgttggtttatatgtctttgctgatgtaagtaccataatgttttgattactgtaggttttgtagtaagttaattttgaaactggaagtgtgagacctttaacagtgtctgcctttcttttttttttttttcagattgttttgtctattctggatcccttgcatttccatatgaattttagaatcagtttgtccatttctgttaaaaaggcagttggaattttcataagcattgccttgaattgtcctttactttgagaatataatattcttacttaggtacaaacataagactttttgagtactatgtttgggtgtgaccttattctaggtaacaagcatttcacagaaatagaaggccaaaaggtacatgaaaagatgttcaacctcagtcatgaagaaatgcaaattaaaaacaaaattataatttttcacttgtcagattggcaaagattagagtgtagtgatgactagtcttggctagactgtggggaaaatagaagcttctgagtttgaagtttttgacacagtccctttggagatcagtagcagtagctatcagaataaaaaatatgaacaaccaaagtttcactttcagaaatgtattctgtacctgtacttgcacaaatataccaagaagtttgtacaggatgtttactgcagcaacatttgtaataccaaaagacaggagtcagcctaaatatcatcaagaggactagttaaaattgaagtactgcatacaatgaaatgccctgtgagccactgaaaagaatgaggcaggttagtatgtaaggtgacatggagtccaagatgtattgaatgacaaaatttgttattgtgtggttctattagaaattaaaaaaaaaaaacaccagaaatacttgtatacacacctgtatagaaaatggctggcagtatacacagaaatagttaacagagattacttctgggcagtagaactggaaatctcattaaatcctttctcattacttgactttttttaaaacaatgagcaggtttttgttttctgaaaaatcattaagaatgactcagtagtgcaagtaaaattaaaattaatactactctttaggaataaaatatttgtttttttctgtcagtttgattgttttatatataatatctgttggtctctagagcagtttgattgttttgtatataatccctgttggtatccagaggtaaatgcattttattgtgatttttattgctgtgtggaaaatggattagaattagttcttgggtacaaatatttaatagtatttggaaccatatttttcatttctacatattgtaagtatgggagaaaaataagatttatcttttaagagttgtgattgtgctagtttttaatttatcaaatgaagaatatttaagaatatttaattctttaagtacaaagaatatttaagaatacttaagagcattgaagcctgattatgccactgttctttgggttcatgctctggaacttaaggttcagtgaagaaggtaaccatttcatagtatctcccttaacaaaggttactgatacattttcagaaaccttagtaccacaggcagtaaggaggcagtgagatccctctggattttgccagaccattcctagaatttttaaggtgaggggaccaatttcccaccccatatagaaatggcaccaacatctctcctagaaacttcctggtgattggaaactttttatctgttgatgctggttctgtctttagggagaatgtcatgtttcatgtaacatatcttaaaatatttgaagatacctgtcatatcctttatttagaaatctttattgaaatccaattaatggtcaggtactgcccttcatacttctctaggccgaatattcctaattccttccactgatcatcttaagacctcatttccagaaatgtcaccatagtatgccatgcttggtagcaggctctaatgatgccctaaactgaatatagacttctcaaggtatggttggattgttgtgaaatagtctaggctcattgactcgcttggactaaaaagctatctttctcataatgcagtttaggataatgtttacctttttagcaacaggtttacactgagaatgcttttacagctctttaaatgatgtatgaggtcaacttaacccatgtgtttgtctgaattattattgtagagccttagcatctggtatgttagtagttggtttttcggtatagtagtaggttttatatatatatttatatttatatttatttattgtcaatagagttagggtctcactatgttgcccaggttggtcttgaactcctgggtgcaagtgatcctgctgccttggcctcttaaagtgctgcgattacgggcatgagccacggcacccagctagtagtaggtttttacatttatttctcataagtatacgtgtatgcttttgtaaatgttgaggtggtggtatattgcctcttctcgttgattctgcctgataatcagcttgttagaattttgttttggtttgtagttctccttgaagaggtccttcacatcccttgtaagctggattcctaggtattttattctctttgaagcaattgtgaatgggagttcactcatgatttggctctctgtttgtctgttcttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactttgttgaataggagtggtgagagagggcatccctgtcttgtgccagttttcaaagggaatgcttccagtttttgcccattcagtatgatattggctgtgagtttgtcatagatagctcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtagcagttcctccttgtacctctgatagaatttggctgtgaatccatctggtcctggactccttttggttggtaaactattgattattgccacaatttcagctcctgttattggtctattcagagattcaacttcttcctggtttagtcttgggagcgtgtatgtgttgaggaatttatccatttcttctagattttctagtttatttgcgtagaggtgtttgtagtattctctgatggtagtttgtatttctgtgggatcggtagtgatatcccctttatcattttttattgtgtctatttgattcttctctctttttttctttattagtcttgctagtggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaattgaggatacaaacaaatggaagaacattccatgctcatgggtaggaagaatcaatattgtgaaaatggccatactgcccaaggtaatttacagattcagtgccatccccatcaagctaccgatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccataacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggaaacctacaaaatgggagaaaattttcgcaacctactcatctgacaaagggcaaatatccagaatctacaatgaactcaaaccaatttacaagaaaaaaacaaacaaccccatcaaaaagtgggcgaaagacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaaaacttggaactaacccaaatgcccaacaatgatagactggattaagaaaatgtggcacatatacaccatggagtactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagaccacatggacacaggaaggggaatatcacactctggggactgttgtggggtggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaataaataaatttaaaaaaaaaaaagaattttgttttggttatgaggcaaggtgggtatccctctccagccttgagttaatgtcatcttggataagtatgctattcagtatttatctgagttgttgataaaatattaacagaatagagcctcgtggcatacctagtggtactgagttattaatactactggcccacctgtcagaaattatgcagtttagctgtgtattttcatgtgacagtgtttataaaatgtcttgttggcatcagaagactgtacagccttactgtacttaagacatgctgtttttaaatgattgttttctccttttccaaagttaaaatctgctgtatttatttaagatttttttggtgtgtgtatgggggaagaggggaggtggaaggatgaaaagattctttgcactaagtttgcttttggttaaaaagaagcctgtattcttagatcttaaatctagtctcactatactaaaattagtcccctaaactggatttactttgaaacttttggatgacctgactaatttaaatattgtacaatagttaagaaggaggacttttagtgttacacaatggttcggttcctggccatatcacttactagttttgttaatttctttttgtgttgggcacattacttctttaatctttaatttccctatctaaaaaagtagtaaaaataatgccctcttcagattgttttccgaggattaagtgaagtattagaaataaagcactcagcatcaagcactggtacttagcagcttaacgggcaaacctgctctttccctcctcctcctcctccttagtactcttcttcctattatgtttcctccaactgttactgtgataacatataaatgactaaatgtgaaatcagtagagttttagactttttttttaactcaaagcttcaaactaaaaacagtgtatttcttgcagatcctttaaggataaatagttgatcttttaaaatgaaagtgccctgtgaaagtttcatagctaaacatttttgttctttagtttaaggcttaagccatataggtttttttgtttgttttttttttgatttgttttaactagtcaagtgcatttcagtgagaagggagaaagagtagaaaggtgttggatctgtaactgactgtgaacaatcagttgagataactcaactgccttcagaccagccaagccctatagttttacaagaaaaaacccattcaggttagtaactcatgttgaattacttttggctactttgtgttcaataatatcattctggggtgtctttgtcttttttggggggcaaggaaatggggtcttggtattttgcctagcttgggcttgaactcttgatcttctgctttagcctcctaagtagagggtgtctttgattatatcttaataaaaggattggaagttgaagcaaggaattaaaaacataaatgtgaattactgatagatgttaggcaagtagttgtgtaggtgggactaacttgcttgactaagattttgattgcccatccctttcacgttctacctccctaccccataacataccttgaacatgaaaacatggggaacatagatttcaatagaagaagcccaattatttgtgaataagtatgagaaccatctggatattctgcagttgttataatacagagcaaatagagcattagcacctacgggaaagcagttggattgttgaatcttctttgacttgtttgttgctttggatgacaggagggttccttcctacctcttagtaaagattgggaaagaaaagagttaattgtgaacttactgggattaattcattctgggttttttttttttcccccccttgagacgatgtttcactctgttgcccaggctggagtgcaatggcgtgatcttggctcactgcaacctccgcctcctgggttcaagcgattctcttgtctcagcctcccaagtagctaggattaaaggcgcctgccactacgtccagctaatttttgtatttgtagtagagacagggttttaccatgttggccaggctggtctcgaactcctgacctcaagtgatccacccgcctcagactcccaaaatgctggaattacaggtatgagctactgcgcccggcctaattcattcttaattataagaatgtacagtttttgtttagggatatagtgttagttgaaaaattagggaaaaagtctgttacttagcttagtttttcatttatccttttatttagcagttactgagtaccagctatatgccaggcatagtgagtgttggtttgtgtgacctgcagttcttgtagctattgagtttatagtgtagttgagggaaaaacacgtttggatgagcagtgatagttacgtggtaggggactgagtgtgagtaatcggttcagggttgtcgcaagccaacacaaaaaagctcatagaaggaatgaggcctaaaagcttagtgtagggtatggagtgtgcaggctggacctggcttttgcctgcagaaatgtgctacaagcatttcagacaaagggactcagtggtagacctcttctacatatgccacttcagtagtgtggttttagattttatatttagccatttatatttagcctgaggcgttctgagtcagtccaaatccactgtcactaaataaatgggttatgtatcttaataacagaggattagccatccttatatgtgaagggcagcattactgggacatgtaaagcaaacttatttgtgacaacagaatatttaagtatagttaataaataggattcttatagtctcctattaggtaacattccttttagagatcctcatggagtatgagtatttaaagtgaggtggaggccaggcacagtggctcacgcctgtaatcctagcactttgggaggctgaggtgggtggattgcctgagcttaggagtttgagaccagcctgggcaacacggtgaaaccctgtctctactcaaaaaaaaaaaaaaacaaaaaattagccaggcatggctgcatgtgcctgtaatcccagctacttgggaggctgagacagaagaattgctttaacctgggaggcagaggttgcagtgagcagagatcgcgccactgcactccagcctgggcaacagaacaagactccatctcaaaaaataaaaataaataaaaaaataaagtgaggtcgaaactatgattttcttggaggacgggcccaaaaggtgattgattagtagggttaaagattaaatttgtgcttaaatttatatatatattttttctttcttctttttttcttttcaaagccattatgtattgctgcagtaccaatttcttttgccttagcggggaaacagctggtaccattgcaggcagaattcaagttccctgattaatgaagtggaggactgtttgaatctttaatgtcttacctttatgtgtaacttgacccctcagttctcctttttctttttttattcagccactcgacagctcaatttttctttttctttttttattcagctctcagttctctatctttttattgtccaaaaaccatacaaatggtgttttcttgcccacttttcttactcatgttgaggattggtttttctaaacatagcttttgtaaatcaatgtgtactgactgatttcacttccctgattatatccttaaagcagctaaggtcattggttactataaatgaagtacacacaagtccgtgacttgtgatggtttgacttaggatttttcaacttcacgatggtgtgaaagcagtagacattcagtagaaactgtacttctgttcttcactttcagtacagtattatttattaaatacatgagatagtcaacactttataaaataggctttgtattagattattttgctcaactgtaggctaatgtaagtgttgctgagtgtgtttaaaataggctatgctaagctatgatgttcgcttcggtaggttaggtgtatgaaatgcatttttgacttgttactttcaacttatgatggatttgttggcatattatcccattgcagttgaggagaatagtggattctatgaagataaacttaactaccaggtaaaagacatttcttttttttaaaagcagattaataatatgtgaacgcctttggatttgttttatctaagtaagactttagattttgttgtgttatagatggtttgcaattgtgtttaacacataacagctgggaatgagtgccagagtattatttctgaatcttgcttacatggtagtgtgtgctaaaaattaagatgtaaaacttttgcttttattttacctcgacatttaaaaacactagtaaaacttgggatcaggtgaaaacttttttgttttacttgcaaaaatattctcttaaaaatattgtggtaaagagatctagcctcttaatgaattttaaagtatacattattgttggctataggtacaatgttgtacagcagctctctagtgcttattcatcttgactgactgaaacttcatgagctttgattagctactctccatttccccttctcccagcctctgctaaccatcattccactctttgatttttatgaatttgtattattttagatagtggagttatgcagtcatttgtctttttgtgactggcttatttcacttagcatggtgtcctcaagattcacccatgttgtgccattttgtagaatttcttttttttttcaagctgaagttttatttaaattgtaaaagaaatggttcccaaaaaatgctggcgaataaagcaaaaggataagatatagtgctcccttcctacgagttagccagcctatccgagtacagggtaatatatagtacttaatgctggtagaattttgcagtagtttagaaagattatctgtgcctagattatgaagagattctcagtgtgtgatgcttggttctgggtttacaccttactgggcatgaacaagagccctctccttggccatagccaaatcccttgggcccaaagttctttgcatagcaccctttacaatagatttcaccttctttttcagtcaggagttgttgattcaagactcttcccacactttgcacatcggaaatagtttttgttccagggctttccagctccagttaccttctcagcagcatgtacggaatccccacatctggaacacttctcagcacctctgtatttctgagcaaatttagaagtctttggatttgcttgtaggcatgtgaggctgaacactctggcttgatgcccaggctctcaccacggtccatgttaagtatgccagcgccctggccataaactgtagccttttggcccatacttctttccatagcaggatttgcagtaaatctcttaatcatgaattgccactgtcttgctatctaaattattcctgcaaatcatgcatagaaagcagcagcagtgggccgggcgcggtggctcacgcctgtaatcccagcactttgggaggccgaggcgggcggatcatgaggtcaggagatcgagaccatcctggctaacatggtgaaacccggtctctactaaaaatacaaaaaaattagccaggcatggtggcgggtgcctgtagtcccagctactcgggaggctgaggcaggagaatggcgtgaacccgggaggcggagcttaccgtgagcctagatcgcgccactgcactccagcctgggcaacagagcaagactccgtcttaaacaaacaaacaaacaaacaaaaagcagtagcggtggaagctcctgccattacactgcacctcttctgcgtggtgcacggccctcccgcagaccccacacttgtttccacctctccacgcaggcattttgagttggaggcaggagcacgcatcacaggcggagctagagaggctgggctggagggagtgtccagggagtccgagatcgctagaattttagaatttctttctttctttcttttttttttattgagagagttttgctcttttcgccgaggctagagtgcaatggcgcgatctcagcttactacaacctctgcctcccaggttcaagcgattctcctgcctcagcctcccgagtagttgggattatagacgcccactaccacacccagctaatttttatagtagagaaggggttttaccatgttaaccaggctgttgtcgaactccttactgcaggtgatccgcctgcctcagcctcccaaagtgctaggattacaggcatgagctaccacgcccggcctagagtttcttttttaaggctacatagtattccattgtacatatattccacattttaaaaatcctttcatctgttggtggacattaggtttctgcagctatcactatcacattgtgaatagtgttgtggtgaacatcggagtggtaatatccgtttgagatcctgatttcattcttttggataaataccccaaagtgggacttctggaatatatggtagttctgtttttaaatttttgaggaagcttcatacttttttccatagtggctgcaccattttgcattcccaccaacaggattccaatttcttcacatcctcaccaacagtagttgtgttttgttttgttttggttttttgataatagttttccttacaggtgtgaggtaatattgtgttgtggttttgattttcatttccctaatggttaatgatgagcatcttttcatgtgcttactgcccatttgtatatgtttggagaaatgtctgttgatgtccttagcacatttttaagttgagttatttgtgtttttttactgttgaattattggagttctttatatatttggagactagccccttgtcagatgtttgcaaatattttctctcattccgtaggttgccttttactctgttaattgtttcttttgctgcgtagaagctttttagtttgatgtagtcccacttgtttatttttgttttggttgcttatgcttttggtattaaatccttgagataatcgccgacaccagtgtcatgaagcttttcctgtatgttttcttctaagagttttagtttcatgtcttaggtttattaaatcattttcagttgatttttgtgtatggtgtaagaaaagggcccagtttattttttttaggtttttacatgtagatatgaagttttcctgatgccattcctttcctcattgtatattcttggcatctttgttgaagatcagttgaccatatgtgtgtggacttatttctaggctttctttctgtgttcttgtggctctatatgtccgtctttatgccaataccatactgtttagattatggtagctttgtaatattaatatattttgaaatcaggaagtatgatgcctccagctttgttcttttacaagattgatttggctatttatggtcttttgtggttccatatgaattttagaatcgtttttccatttctataaaaaataccactggaattttgatagtgattgcgtagaatttatagatcactttgagtaatattggcatttaaaaatactaagtcttaacaaaacgtgagcataggtgtttctgtttttttgtgtgtcttgtttaatttcattcattgttttctggttttcaataaacaaacctgtcacctcattcaagtttattcctaggtagttaatttttttctattgtaaatgagattgttttcctaatgtccttttcagatagttagtgtatggaaacattactgatttttatatgttgattttgtatcctgctactttactcaatttgtttattctaacagttttttaaaaatggaatcttgcgagttttctttcttttttttttttttttttttgagacggagtctcgcacagtttcccaggctggagtgcaggggcacagtcttgggtcagtgcaacctccgcctcccaggttcaagtgattctcctgcctcagcctccgaagtagctgggattataggtgcctgccaccacacctgactaacttttgtatttttagtagagatggggtttcaccatgttggctaggctggtctcaagctcctgacctcaagtgatccgcccacctcggcttcccaaagtgctgggattataggcatgggccactgtgcctggcccaaaagggacaattttactacttcctttctgatttggatgtattttttttattttattaagcatttaatttattgcttaattgctttggctaggatttccagtactatgttgaactgaagtagggagagtgggcatccttgctttgttcctgatctttcaggaaaagtttctgttttttgctattgaatataatgttggctgtgggcttttcatatacagtctttattatgttactttctttttattccttgtttgtagagagtttttataatgaaagggcgttgatttttgtcagatgctttttctgcatctattgagatgatcatgtgatttttatctttgattctgttaatgtggtatattaatacattttttatatgttgaatcatccttgcatcacaagggtcagtagatttccctggtatgaaacccacttgatcatggtgtattacctttttgataggctgttagattcagttagctagtattttgttgggaagttttgcatctatatttattaaggatattggtctgtaattttctttttttgttatattcttcccttgttttggtgttagggtgatactggcttcatagaatgatttacggaggattccctctttatctttaggaatagtttcagtaacggtagtaccaaatttctttgaatgtctgaaataattcagctgtagatccatctggtactggactttttttttgttggcaattttttcattcctgtttcagtctcaccacttgttattggtctgttcagagtttctgtatcttcctgatttaatctaggagagttttatatttctaggaaattaaccatctcctctggattttctagtttgtgcatgtaaaagtgttcatagtagccttgaatgatcttttctatttctgtgttatcagttgtaatatctcctgtttcatttctaattgagcttatttggatcttgtctcttcttttcttggctaatgttgctaatggtctattgattttgtttatttttttttaaagaaccagctttttgtttcatttattttttgtaattttttgtttcaatttcatttagttctgctctgatctttgttacttattttcttctgctgggcttaggtttggtttgttcttgttctctagttccttgaggtgtgaccttagattgtctgtgctctttcagactttttgatgtaggcatttaatgctgtgacctttcctcttagcactgcttttgctctgtctcagaggttttgataagttgtgtcactgttacccctcagttcatagaattttaaaatttccattttggtttcattattgacttgaagtcgtcattcaagagaagattatttaatttctatgtatttatgtagttttgagggttcctcttggagttaatctccagttttattccactgtggtcagagaggatacttcatataatttcagttttcataaatttattgagtcttgtttaatggcgtatcatatggcctgtcttggagaatgttccatctgctggtgaaaagaatgtatattctgcaattgttgggtagaatgttctgtaaatatctgttaagtctatttgttgtagggtatagtcttaagtccattgtttctttcttgactttctgtcttggtgacctgtctagtgttgtcagtggattattgaagttccctcactattattgtgttgccgtctgtctcatttcttaggcatagtagtaattgttttataaatttgggagcttcaatgttaggtgcatatatatttaggattgccacattttcctgttgtactagtccttttatcgttatataatatccctctttgtctttctttttttttttgttggagacagagtcttgctctgttacccaggctggagtgtagtggtgcgaccttggcacactgcaacctctgcctcccaggttcaagcaattctcctgcctcagcctcccgagtagctgggattacaggcacacaccaccatgcctggctaattttttgtatttttagtagaaacgagttttcaccatgctggtctcgaactcctgcccttatgatccacctgtgtcagccttccaaagtgctggggttacaggcgtgagccaccacacctggcctcctttgtccttttttaactgttgttgctttgaagtctagtttgtctgatataagaataactacttctaggccggaagtggtggctcacacctgtaatcctagcactttgggaggcataggtgggtggattgcttgaggtcaggagttcaagactagccttgcaaacatggtgaaaccatgtctctactaaaatacaaaaattagccaggtgtggtggctcacgcctgtaatcccagctacttgggaggctgaggtgggagaatagctgaacccaggaggtgaaggttgtagggagtctagattgcatactgctctctaacctgggtgatgaagtgagactctgtctcaaaaaaaaaaaaaaaaaaaggataactacctttgcttgcttttggtttccattttcatggaatatctttttccatccctttatcttatgtgagtccttctgtgttaggtgagtctcttgatgacagcagatccttggttcgtggatttttatccattcttccattctgtatcttttaagtggagtatttaggccatttatattcaacgtgagtatttagatgtgaggtactgttgttttcatcatgctagttgttgccttaatcccttagttttttgtttttgtttttttttttcattgcatcattgttatataggccctgtgagatatatgctttaaggaagttccattttggtgtattttgaggttttgtttcaagatttagaacttgtggtgctggtttggtagtggcaaattctcccagcatttgtttgtctgataaagactttatctctccttcatttatgaagcttagttttgctggatacaaaattcttggctgataattgttttgttgaaggaggctaaatataggaccccagtcccttctagcttgtagggtttctgctgaaagatacactgttaatctgataggtttttctttataggttacctgatacttttgccccacagctcttaagattctttccttcatcttgactttaggtaatgatgactatgtgcctgggccatctttttatgatgaatttcccaggtatttttgagcctcttgagatttggatgtctagatctctagcaagaccggggaagttttccttgattatttcctgaaatatgttttccaaactttcaaatttcttttcttcctcaggaacacgaattatttttagctttggatgtttaacgtagacccagccttcacggatgctttgtttattttttttaaaataatttttctttatcttggcagattgggttaattcgaaagcattgtcttctgtctctgaagttctttcttctgcttgttcgattctattgctgagacttcccagtgcgtttggcatttctctaagtgtgtccttgatttccagaagttgtggttgttttttatttatgctatatatttcactgaagaattttccttttatatcctgtatcatgtttttgatttctttaagttggacttcagctttctctggtgcctcctttgattagcttaataattgaccttctaaattctttttctggcaattcagagagttcgtctttgttcggatccattgctgatgagctggtacgatcttttggtggtgttaaagaaccttgttttgtcatattaccagaattgtttttctggttccttctcatttgggtagactatgtcagagggaagatctgggattcaagggctgcttttcagattcttttgtcccatggggttctcccttgatgtggtgttctcccctttcccctaggaatggggcttcctgagtgccaaactgtagtgattgtttttgctcttctgggtctagccacccagtcgagctaccaggtgccaggctagtactggcgagtgtctgtaaagagtcctatgatgtgatccgttttcaggtcttgcagctgtggatactagtacctgctctggtggaggtagctggggagtgaagtagactctgtgagggtccttggttgtgtttttgtttagtgtgctggttttgtgttggttgtcctccagctgggagttggcactttcaagagcatatcagctgtggtgctacagggaggatgcacatttgccctagagacacttggtcaagtattcaggtttctcaggcagtgagcaggcccatagagctcccaagagattatgacctttgtctttggctaccaggatggctagagaaagactacgaggtgggggcaggaataggggtgtctcagcctctccttgggtgagcttgctgcagctgctgttgcggggggtggggtgagggtgtggttcccagtccagtggagttatagtcccagggggattgtggctgcctctgctgagtcatacaggccaccagggaagtgggggaaagctggcagtcacagaccttaccttgcttccatgcaacctgtggtcttaaaggctggtctcacttccatcatgcctccccaacatcaccaagtctttttccaggtagccggttaccagggtggatactttgccccagaccacaagcctcccccttgagaaagcaaatggactcatagtttttaggcctcccagagaacctgcagtggtgatccaatttcttcaaagggtctgtggattctcttggctttcctggtttgttcctgtggtagttcttgtattgtagcaaaagttcatgatgtgagtctccacatgttgctctgtctgtcagaatgggagatacaagctagtcctgcctcctatccaccatcttaatttgagcatctagatatagtttcgaataatgtgtatctacctacaaagttcaggcatggaacgaggcaaataaaacaaacacaaaaactggatagcaaaactactccaatgaggagataaaggttttcaaaaagtacttgaactggaaagcctaggtgatactaaaacattaaataaaatagtatatccaagacccagtatgtgttaatatatgggataaccagatcgttttaactgctctggctaatcctcatttctataaatatgtagacaaaactagcactgctgtatggtaataactaccagtatactgctttgtcctttaaaatgtgtctgccatactaggctcaaactattaaaccaagtttttctactaaggctaggaatgtcacatgtatgcagggatgagaaccttatcacacacactcacgctcacataccaggtctctcagcccttgggcgtcgccttccaactccatgtgtattttatgcatgtgatctttatatgtgttctttcgctgttttcctatcatgtgaaacacattaaacatctcaacacatttgcgcctggttttggttgcccagtagtattcttgtgtgcaatgaaaccagtgagcaagtacacatagtaggaattataccatcttggtagaaaacagctatataaacacggatgtacatatttcactggaaatctcaaggacccacctcttcagtctgtagcagaagtctgcttgccacatcagatccttttacccttcacctctattcttggaccccaaagcagggccagtgcttttagttttgtatctggtgtcctcaaaatgaatatggaaagttcataaacactatataagtactatgtgaatctggttgaaaacaggtaaaacaacaaacctacatatactaactggtagttaaatttatttcacaagaaaaccatctttaagattttttttttaactttttttttttttttgagacagagtctcgctctgtcgcccaggctggagtgcagtggcgtgatctcagctcactgcaagctctgcctcccgggttcatgccattctcctgcctcagcttcctgagtagctgtgactaccggcgcctgccaccatgcctggctaattttttgtattttttagtagagacggggtttcattatgttagccaggatggtctcgatctcctgaccttgtgaaccgcccgcttcagcctcccaaagtgctgggattacaggcgtgaaccaccatgcccggcctttttaactttttaaaatagagaaaacagtatattccttggggaaagatgaaggattgagaaaaccagctctgggtaaaaattattatgactgcacctggagttgattaggcctgcctaggaaagaaacaggcaactgctatatgaccacaggggacagccaccatctgagtctcagcagactagttcacacgccatgcaatgttgctgtatattcaaattgtaaaaatcatctagcttatcatgaaacaagctgcatttatcatcagagactgtcaggtcatcatctccacctgcagacagagcttaagcagcatctcacctatctcaaagatgacagactcttgtcactgttgtcaaaggggttgctgttctgtttcctcagtgagctcccagagttggttccttccttgggccctgtatctgtttatgttcccattttctgtctctggctccttttaccaccatcagggtaggcagacttggaacaattctctccaaatgggcagcttccatgttcttcgttaaaatacctacatgccttatcactcttcatctccttgtattcctgaaatgagtttctgctaccttctactccacgcagtactcatgtggaatgacaaagttaaatatggcctggcattctgggatggactttaccatcttgcttttctgttgcttagtactcctccacttgtgaacacacttgaggtgcaggtgtggttgcagctggagagcatctcaaagcagccctttatatatttagagagtatcatgcccctttagtgttttattgtttattatatgaaataataccgtttcctactctggagatttacagctactttgagcccatggaatacccccaaagggttttatgtaaagtgtgttcaaatgtagaccctatctatataccaactaccaaaggattagttgagaaacattttatgagtaaggctgtcatattgcatgctgggtactagagttagcaatttccaatatattattgatagaaaagtaaacattaataggaaattatcatgaactgactttactcaccttgtttagtctgtattgaccttgttggaagaaaagtattaatagctgtcatttgagctcttactagtggtaagtcaaatgctgtgttagtgtatttaatcctcaaacatctctgtttagccatattatccccaggttatatatatgaagaagatgaggtttggggatcttagaaataagagattttattgatctgtcactgcaggcagtgtaaatatatttgattcttcttaattttgctttatgatctcacaagatgaaataactatgtcatctatttcaattctcattgttttaagatttaaatcattttggggggaatcttctccaatgttttacttaggaacggttcaatgaagtctttcccctgtcctagtttgttttatagatttgaaataagggcatttcagtggctctaaaacatgtgtgtagcttttgtaaaattcctaatcttttctctaagtttttacatttcttaattatgtaaaaatattatgctataaaataatttcagtaatttgcagtaaagaaaggtaatctgtctctagtttcctcatatttattcaccgatatctcctcattaaaagttgaaaaatactactgctctttgttttaaagtatttaaacgtccaactgtactttttacataaataagattagaaaacatgaatttgattgttccagaaactcagtcatactgagagaagactttttttcctcagcaatttactattttttggagtaaatgcaaaaagcctttatgtgtgcaggcctctgtaatgacactctaatgtagtagaatcttctttgatttcatttgcttaaagatactgctttaaaagttttagggaaatattttatcctaaaaatgttaattatccaaggttgaaaagatcttacctgacagcttaaaaacttgtatctgggcagtaagatgataattttagtttcagtattattttaattgagtggatgtgtggcaattcaagtgttttcgtctcttaagtttcagtagtgggcagcttttgtctcccttctgttttcactcaaagcattttgtctgtaaagaatctcagcttaggactcaaaacaagtctgtgttgaggatttatttctagagttgtgttaaacagttttctgtagctatagataattacttatgaagctgcatcaagtacgtaccttgattactactatctcgtgactaactgcttgttcacagccttccccacccttcccaccagctccccttcactaacctgtgcatcctttgcttgtctggtctcttttacttcttgtttttctcctagtttgtgaatagctcttaaagtctgacttgttgtcatggtgcgttgaaagagtagccagttgtcttttctgggtagatcagctatgagctgactgactaagaggagtagttaaaatggagaaagcttagctgtactttgtcttgcatgttaaacgtaatgagtttagaggattatgattatttgtaatcatcaggatctgctagacaggacatctgttttactttttactcttatgttggtggagaaatagcgtgcttttcattcaatgtgaaaattttgtgttctagctgggcaccgatggcttagtttttgaaatgtaatttcttgagaagtagcatgtggttagtataaaattgtctttcctattaggactagctacgtaattagtctgaaatatttttctaactggaaaattagttgctgtgaacttttggatttttattattctagactgcattacacttgtttgctatattcaaatattttttctttggttttacttcctaggttgcacgttttcaaaaaatacctaatggtgaaaatgagacaatgattcctgtattgacatcaaaaaaagcaagtgaattaccagtcagtgaagttgcaagcattctccaagtaagtggttagtggggaggaagggactagatggtgtaaagtcagtcacttagactctataaaacagtgctgtctaatttacttttcttcagtgatagaaatattctgttctgtgccattcagcatagtagccacaagttgaacaggactgttgagcttgacatggggttaaacttgacagaattaaacatgactatatgacttgaaatgtggctagtgtgatggagaaactgactttaatttaatttaaatttatttaaataactacaggtggcttagtggctacctgattggacagtgcagctctagaacataatagcttttctaggaactatattagtgctgtgtaaggattggttggattaggaaaataattaacgtaagtagtggtaggagtttatctttttttgataagggttttctaaggtaaagtaaaaacttaagtacaagtttagaattgcagataatctgtaattgcttatgtaggctcttcctggttttcaaaagtagtatctatcgaaacatgaaaaagataatattttttatttttccttcagcagtcacatatcttagtgatagcattaaaaacatgggtatccttttttaggtttttgttgttgttgttattgtatttatactctgctttaaaaccacttatttgtaatatgtttgttttgaaaggctcctttattggactctattataataaccttttggtcagggcaactattttgggggtacagataattttattctttaatagttagaatactaaatcatgagagagaataactgaaggatgtaggtagtgtttatagaacataaactgttccaagaagaagttcatctgaacttcactgcttttgagtaatttaggaagcacaaaatttgagcatgaaataattacacagtccaagagtataaattaataccaaccccagggttttgataggcccagagaacaaggaagacatttatggcccattgaacgttctttgggagaaactaattttagaaaatggcgaaacaacaatgaaaaggaaaaagctaattaaaatgtactgttatgctttctgtaagtcttgtggctgattgtgttatttttctccctaaattttgtttgtttggtaaactctgcctttttgtttacattttttttaaaaaatcaattttgttgagatataattcacataaaatacaatgtactttttaaaagtgtacaatttgcattttgacaaatgtaatcaccaccaccattaagatagaacatttttatcactccagaaagctcccccatgtccctttgtaattaatccctccctctctatgtgtcacttctggtcccaggcaaccactgataggttgctctcataatagactagttttgactgttgtagtttctgtaaatgtgataatacattatattatgtgcttttttgtgtttttcttttctgtgctaacattttcaataactttcatgtataaactctaataggctgatcttcagaatggtctaaacaaatgtgaagttagtcataggcgagcctttcatggctggaatgagtttgatattagtgaagatgagccactgtggaagaagtatatttctcaggtgagatacttttacttcctcttctactgtgtaatttattaatacatggacttctgttatgtagttgcttacttttgtgatactgtttatggagaaaggaaataatttttagatgttttttacctaaaatttttcatttgttggggcttactgttaggttggaattcctgtatttttagtatgtaaatcttaaagacaacattttccatatgggtatattacacaaagataatactgttgacagtagtgtcctttgctgatatcaaacctacactatttaaatgataggactggcaatattttttaaggtaatcatggccagctcagaaaactagtaaaaagtaagttaggtaagttaaactcaggctgcctgggtacaaattacaccttcatttcttaccagttgtgtcatctttattatcctctgagccttatctataaaatggtgatgataaccttacgggagatagttagctctcagtagatgatagttatttatattttttcatcctaaattttaggaaagacttattctagactgcttttatcttgataacgattgtgttaatgtaaaaagttacaggttactatgattagttttgaagtaattaggttggtttgctaaacaaatattttttgctaaaaacttctttttagtaaatgtctgtgccttttaacctgcggtctttctaaaacgatctatgtttaacttttctaaagtgccttttctgctaatgagcttaaatttgccaggcttaattttgcgaatgagtttgtctaaagtagcaacactggaattttaaaggttggatgaaccttgtgtgtatatgtcttatttttatggaatattatttatatgtgtctttgtattttcatacttaccacattcccacattaccaaagacttcagaaagcattaacatagtttactctggatttataaattgtaatgatttgacttatccctaggcagtatgatttaatgttttactttcttgatcctgttaccaaagctagagcacctgccccttgggattcctgtgagaattaaatagtgcctgtaatgtagttaagcacaactaaacaaataacagtaaatagtaatcgtaatcacaaagcactgggtgattctttattcctctgcagcctgccatccatcaagtggtgtgcttagtaatgtggcacagcttttttaggggaaaataaaaaagatcatgggtcttgccctcaaagtgtgacgttaatagctaacatttttaagaactttttttggtttacacggtgctttaatgtacattcttagttaatccttataacagttctttggtataaggttctgttttaccagatgaagaatctggagcttaaaaagattaaggtgacacacagatgccagcaactggattcaaacctaggtactctgactcagtcaggtttgtggttggtcagccctgaaccatattgcagttgcagtgttattttattagggcagtttaacttattattttttaaaaatcctcgttagaatcacttggggagtgcttaaaaaatgctaaagcctgggccttatgcctaaagattttgatttaattaacttggtgtgaatctgggcattggtattgttaaaagtttcttataggattccgatgtgaagaaggattgggacttgttccagggaatggaaccataaaggggctttggaggtggtggcatgtaacctcagagctatggtatctaagggctggggctttctggtgggatggattctttttagcctaattactttgcaactttgacagtgatgtaacactttagcagaggaagagattctaacatcagagtttcaaggaatagaatgtccaactggaagaatttggggttgactctggtgtgaggtcatttaaatgctttctgatcaggttgatgctatagtcctgtttctttgatatgatttgctgtggtagatagaaaccaggaaagctagccttgaggaaaatcttcagtttcttttgtggagaggagggaatttttctgtgatatgtgagtcaaccacagaattgtaatctacaccattgtacttgagaaatgtttgaatctcagtgttctattcagtatttcgcccaaatttttagcttaaaaatcatcttctcctgctttttctagcctcagtagaaattcagaacagctgtatttcttaaattaatataccaaaaattgctgtatactataaggaattggttaattcttagttttaagtattgctatttaattttttttttctgaaaaggaactgttaaaaagcttttaaatgtagttaagtataaacgctttttttgttaattgaagagatacataaaataaactgagtatagacttttgtaattttccagtcatgctcttatggttttttttttttaaagcctttgctgagagaactgtcatgtacaaaactgtgttgaattgctgtttgtttttactttcagtttaaaaatccccttattatgctgcttctggcttctgcagtcatcagtgttttaatgcatcagtttgatgatgccgtcagtatcactgtggtaagaaaaaaattacatatttttaatctgttgagtaagtgtataaattgggattggtttttattttggaaaataaattgagaagtgctctcagatttttttcagtgtccaaattctgcttttattttattctttttgttgcgacagtttcttgttgtattgcccaggctagagtgcagtggtatagtcatgactcactgcagccccgaactcctgggctcaagctgttttctgcctcagcatcctgagtagttgggactacaggtgtatgctaacacccccagcaattttaaaatttttttgtaaagacagggtcttgttatgttgcccaggctggtcttaaactcctggcttcaagtgattctcccaccttgacctccccaaagtgtcgaaattacaggtgtgagccactgtgcctggctcaaattctgcttttattatagttacagtaattttgagtaatgttcaaaagtccatgattagcacacatgaaaattctttaactggtaattttcacaaatatgaaattttataattatctgattaaattttaaatttatttcactttgcagttgagaatatattttgactagttgtgaactaaagcctgacatgtgaaattaaaaatattccttatagtgcatgctgtatttacagcatacatttactatatatgattttattctttccagctaggttattctagctttcattgaactgttttctcatctttttccttcttgctccatttcatttttgtataaaaaatttgtagcaagtaaaagcacttatgcttaagaacactgtagatgttattgtagagatgcagctcttgaactattgcttgcagtatcccaggtatccctgagacctgttcaaggggtatgtgaggtcacaaccattttaataatactaaaacattatttgtctttcaattatagacttttggcattaatggcacaaaaacaatggcaggtgaaactgttagagccttagcacaattcagagtaatggcacccaactttgttaacagtcattgttttctttcatgtttcttaagaatgttcttgataaagcagtaaaaattaattttattaaatctggacccttgagtacataccttcataataatttatgtaatgaaatgggaagtatgcatgaaactcttttgtatattgaaatacaatggttgtctcaaggaagggtgatgattgtgaggcaaactagccttgtacttgaaagactgactcatagacaaactatgggtgttaggacttgggtaaccagcagattcttatttttgaaagtgaattaaatgagcgaatcagaccaaggaaaggcaactggcagaatttgttgctaatgataaaattcaggttttcaagcaataattagggttttggaaaatttgtatgcactcttatgggctggatagcatcccagtatttaagactttattccaattagatcagtagtgatttcaacaaatgtgtgttttttttaaaaaaaaaattgttacgaaatgtggtaaccttggggaagatttgggcaatcttggggaagatttgaataaccaagtgaaccaatatttcccagaagaccaatgcgtgacattacaaaatctgaaatggtaaaagatccattcaaatgcaagataggtcaatggatttcgatataatagattatgaaaggtgcattgatacagttttatattctacattgcagattacctttaagtaactagcacttgagttttggtgtagtagctaagaagaatatccacaatcatctgaaaaagctgttaaaatactcctccctaggctgggcatggtggctcatgcctgtaatcccagcactttgggaggctgaggcgggtggatcatgaggtcaggagattgagaccatcctggctaacatggtgaaaccccgtctctactaaaaatacaaaaaaaaaaattagctgggcgtggtggtgggcacctgtagtcccagctactcgggaggctgaggcaggagaatggcgtgaaccccggaggcggagcttgcagtgagctgagatcacgcccctgcacaccagcctgggcaatagagcaagactctgtctcaaaaaaaaaaaaaaaaaaaactcctccctaaaaaaaataaaaaagaaaaaatgctcctcccttttccaccgtatctgtatggggctggattttcttcatacactttagcctgaacaatatgttatagtaaatggaatactagctttctagaaagtcatatattaaaatataaaaatttaaaacactgctatttttctcacaatttttttggaaaatttatttttcataaagttatttgtgttagcatgtaatgaggtttaaaattttttacatgagttgatgagtagaaattaaaactgactagttgaaaaatttgatatggtaaatatcagtatatataacccacttaaaagctggtcctcaatttgtgagagcataaaagggccctgagatcaaaaagttagagaagctgccctggtaatggcaagccactgtaaactgttagcttctttccccacaggccttaaggtaaagttgtgatttcttttccagctgatctcagtgtttaaaatctgttattgtgggactgcagatagttagaaaaataaaatacagttaacagttacttctcaagttaatgtctgatttaaaagcctgtttcttttgtttaggcaatacttatcgttgttacagttgcctttgttcaggtaagtactctattttgccaacatgaaaatggtatgttaattgcttaaaaatcaaggtgtcttgtggtagaacctaccgttattggggggttgtaatgcccatcagaacaacttattctttgtttttcaagtaatttcagatacagacaactcttcagggaagcttgtggtgtgggactaaggaactgctttgatttaggtagtgagatgaagaaaatctagttttttatttgataatgttaaggataactgaagcagatggaaacaaaaagcatagtaatagaaataaaatccagcagtaaacttttttattttttcaattaaaaaattggaccagagtttatagtttcataacactgttatgttttaatgcctactagagctaagtctagatgaaacaaaaaagtatagaattaaaaggtcgatctgtgatgtaccatttgaagaaaattccacaggtttctgtgactgattcccttagccaaatgctacacttgtttgctgaatttatcacttaaccttattttatttgagtctgttttgaggaattaaaatggttctactcattgttggcatgacctcctctcccctccctttaaaacaatttctcattcctccacaaaaggggtgttgtgatctgaatcaaagtaattcaaacagtaaataaaacatatgtaaagtagccccttttaaaaattactatgaataatgtggagatactgtcaagatttctattaataagtacagacaaataaaaatgtaggcttagttttatgtttatttaaatatctgaaacttctgtagattttagaacagtgtttcacaatatcagcagatttcctttttagctagaacatggttaacaagaatagaattattctagcttagagaaaaatgtaatattgttgcataagcctgaagttcgtgctgttttgaatctgaagcctatactttgaataactatggttgttcttacatctacgatttattacgtgggtatttcttgtcactatcccagcctcttaaggtaatctctaacctagttgttattagttctgtagtaacccagtgtagaaagccagttggaatcagatcatttgcagtaggtttgtgagctccattagtagactatcagggttccgcttttaggggaatcttcttgcttagacaaatgttgcccatggtcaggtggagctggttagtctagcataggtcatgtcaggctaaccattattcaaggcagctattcattcagccaagtgagtgatatgacccactggaccactaactggaccttcttgcgtctttaagaatgtgtcagatatgtggagtgccctacttcagaaggattcctgcaaatagtatcactatgtatggaagaccttagtaccttgttctctttgatcactagaaagcccatgttttcaaaaaacaccacaaaattgtgattttaacataagtcaatatggaattttacacaagatagtgttgttatacacattaaatgctatggctgagactattaaatatgtttatgataggtacatttgatagaaatctcacaaaaggatgaaaactttataaaaagcctagtttcaaattgctaggtctgattcttacacacatgtgacccatcaccaaatatgcctgtgaaaccaacaaaatagtctataaacaagtaaaaatcctctccaaaaagatcctatttactgtcagttgaacttatcataatgctttaatcaaaaagctctttatcaaaaatgtataaaaaattcttaatactttatcattatttgttatttgtgctatattacttgtgtcttaagagggctttttatattcctttttatatttatgtcctgccttttttccgtgtgtctttgcaatccccattccccacaccactgtacttcttcccagccataaaaatagctaattgttttatatagtcgtaatgaagtcaccttacaataaatttgaaaaatgacttttaggcatttattaggttttaggtggtatgtttaatgatcattttgatatagaggtatctttataattgtagggagtagaggctaagaaaccagaagacataagtaaagattgggcagcatctatgtcatttattactgggatctaggattgatgggtattttctagcatattacagaatttttgggtaaacttccaaattccttaatatccttcatgtgtttggggtgttgtcttatgatttttacatttgtagattttccttatatttgtcactctaagattaagtagagactgattgtgttctaagttattcttacatagccttgtgttttctatttgaagtttgtgatggataggacattttgactagtactagcactgcagtcatttcaaaacattcccaacccttctacctccactatttgcctctccctcttttgaccttagattagaagattcttttgcttactacagacatgaggcaaaaatagcagtgatgtgtgatgcaagactgctcatggaaatgtggactaagtagtattgtgagttgaaggatgtttctgactgaccctcagctatttgttatctggatggaagaaggctagaaatcacattgttagaactcctgagaattttcctttttggatacacaggttgatgggaactgggtctgtcagtatagagccagccacatcttactccttgtttatcccatgtttgttctaatggtttactttgtaaaccattgctgttagcatgggcttaaattcctaaagcagatgttgtttacggttaattatctttgacttctgtggtcattagacacttaacataagattatctaaattttaaggctcaatgacttaaaacttttaatgactcaaattatgtactctttggacatactagtcagttttcatttttattctaaataaccttaggtttgtacattgaatattaaaatgtaaaactgggaatatttaattatcaaaattgatctctacatttaacattttaaaataagggacaagcttttctgggtaagaatataagcacaagtaaaggaaaagatgagaattgggggaaattttaaaataatgattgagattaataagtctaaatggaatatattcatgggagcaaaattaaattctacttttttttgtttgaataggaatatcgttcagaaaaatctcttgaagaattgagtaaacttgtgccaccagaatgccattggtatgatcctttttttggtatggatttctgcccctttaaaaatagaagttgaatgtgactagtaccgtacatattgttatccccactttgtctgaacataaggaagatactattaatctgacacaaaaagttcctggtctcattaatgtagcaaaactgtaccattgaaaactttaaaatccgagattctagagacatggatgtatttaacagattttttttttttttttttttttttttttagatggagtctggctctgtcacccaggctggagtgcagtggcacaatctcggctcactgcaagctccatctgccgggttcacgccattttcttgcctcagcctcctgagtagctgggactacaggtgcctgccaccacgcccagattatcttttgtattttttagtagagacaggtttcaccatgttagccaggatggtctcgatctcctgacctcgtgatctgcccacctcggcctcccaaagtgttgggattacaggcgtgagccaccgcgcccggctgtatttaacagtgtgtgtgtgtgtgtgtgtgtgtgtgtgtgtgtgtgtgtgtctgtgtgtgtgcgcgcacgcgcgcatgcatgcgcgtgtccatgcgcaagtgtgtgctaagccctgttctgggtatagtgattcacaatcaaacagacccaggtgattcaaaaggttgcttcaatttgcacattttacatttgaacaaataatttgtttttcaagttattttctgtcatcttggcatcttaagtgtttagaaacagtctttttcttggttcttatatttgccttttcctcagacaagcctactggaaataattttttaagacaagttgcatgaattttttttttttaaccatggttgtttctatttcgtgttacagtgtgcgtgaaggaaaattggagcatacacttgcccgagacttggttccaggtgatacagtttgcctttctgttggggatagagttcctgctgacttacgcttgtttgaggtaaatttgggatctgattgtaataagtgaaaatacgtggatgtagattaaaggataaacattactagttttaaggaattaacacatagttgatttgaaccatttggtattctactttaaaatgtgacatatataaacttttttttttccttaaaatgtatctgtctctactgtaacatcttttgaggtgtttgtttagtgaatcagcagatctttatagaaacctgcatattagggactgtgggagatacaaagatgatatgacagaatacttgtgactagggaacatactatgtgtacacaaattactcaccataaaatagaactcagtaattgagtaagagaagttcaaagaataggatatagacatttaaagaagggagaggttccacctgatttgaatgagatcagaatatgcctcagaccacatggctttggcagtgataattgaagagtagtactggacaaagatggggaagacaatgaagcaacaccattcaaatcactatgaacattccagtgtatgaaactctgttgggacatggtaagggtagaaaacgtgtgatggaatcagatttcagaggccttggatactaggcttaacttcagatttttttggttaggagttaccttttgaggctcctgtgcagttgctaaataatgttatccttaatctggctacagtgtgtagaatagattgaagaactggaaaatggagataggcacctagtttaacaggctttcaaaacccattagtatgcaggtcttatccaccattggaattaagctgtttgttaacacctgcagagcagtcagtctttaaatactatggccaaaagtatgagtgttctcatagatgctgtagaaggcctgaaaaacctttcagactgtaataagaacaaacttggcttaatctttcagcagaggccttttttccaaatatttgaaatttatccttagaaagctactggattgctttaattgggtgactaggaataattgataatattgcaagtgttactaattttacttcattatcctttttctcgtctttgaggtctttttaatgttaattcttttctactcttctttccttcagttcctaatattttgccgatgacaataccttgaattattcttcctcagagattaagtagtcttgtcacttggcataagttttcttccccctcccccagaaaaccctaatttaaattcatggagttcatgccattctttattctgggctgctgctcttccagttgagaagcagaacttctcattgggatagttagaagatggtgtttctcatttgcatggttcgagaaatataatgatagaaacttcaaaacaccattaatgcttgctaaactattttagggttttcatttaactaagggttaattgacttgacagttaattatttcaaagttcacatgtaaacaggaaagaaaacctgtcagtatagattagtatgtattttatctactcagcaaatatatattgaaaacattgtgaattttttatttttgtttttgagatggagtctcactctgttgcccaggctggagtgcagtggtgcgatctcagctcactgcagtctccatctcctgggttcaagcaattctcctgcctcaggctcccaatagctgagattacaggtgcctgccaccacgcctggctaattttttagtatttttagtagagacggggtttggctgtgttggccaggctggttttgaactcctgacctcaggtgatccacctgcctcagcctcctaaagtgctgggattatagtcgtgagccaccgctcctggccgacattgtgaatttaataagaattataagcatatgtcttgtggagtaatttattagttattattgttttccccctacttgttaactttgcaagcacttcatcagcacgttttattctgcagtactgtagttaggttgattttgttctagttaatccacttttacgtatatagttgaacattttttattctctctaccttaattctgccttatttgttttgcctgttacttgctaccccaaacagacttttgcaactactttgactgcagattgaaataactttccttaaagagttggggatcttttatccatctaaatttaaatgtactgacttaggatatagactgataaagtcagtttctcttctggacacagaagctgctagttttttgaaagtaaattggcttattggagttttgttggctcagtttggctgtggtgatctttggataattttgtaaggctagctggtcatttgatactactgtatgaaataaactgtcattagggtttaaaggaaccagaaaactccttagtcagctttgggatatcactaatttcttccaaagcacatagatttcactttagagaaagcaagtctgtgaacttctgctatgtagttagttctcttacagactaggcctaaagccacagttgcaactttagtgtcatcattttgtaactgtcataaattttagtgctttcagagtttgactgtaaacttgcctgggtccttagcagcttcttgttagcacattcagtgacttgactgttgtacaacttttatctggtacaacttttatcttcataggttgtgtcttagcttgggttgctttaacaaaataccatgccatttatttttcacagttacggaggctggaagttcaaggtcaaggtctggcagggtttggtttctggtgaggactgttgctagcttgagatggctatcttcttgcagagtcctcacatggcggagacagcaatttctctctcttcctcttatacggccactaatggcatcattaggactagcctcatgaccgcatctaaccctgattacttcccagggccccatctccaaatactataacattgactgtagagctatatagcatgtgactttttgggatacatagttaagactgtaacaggttgagactgccattttgtttatactttttaaagactaatattaataacttaaggaattgtgtagtttttcccttgcctgtgtcaggttttcagaagccagtggttgagccaagatagttttcccttggtatccactgaggatcggtcctagtagatccacagagagcaaaatccaaagatgctcaagtcctttacatacaattgagtagtatttatatataacctctgcacatttttctgtatactttaattcatctctagattacttataactcctaataaaatataaatgctatgtcaacagttgttatactatatttttaaaagttcgtattttttttactgttgtattttttttattatactttctttgaatattttccacctgtgattgcttgaatccactgctacagagggaggactatagttggtggcagtggcctttccagcaggagcctgagaggcactgatggagctaggacagtaaaacttagaggaattgagctttgggcatgttatttgtttttttttcccccgagggtttttattttaacttttagtgttgagaagaggcaccactggccaattacttgatgataaccaatggattggtcggacaatgactttagatgaagcaatcttattgactatgtatgcctggataacagtacattttatttttatttttatttcatttatttattttttattattatactttgttttagggtacatgtgcacaacatgcaggtttgttacatatgtatacaagtgccatgttggtgtgcagcacccattaacttgtcatttacattagataatatctcctaatgctgtccctcccccctccccccaccccacgacaggccccggtgtgtgatgtttccaaccccgtgtccaagtgttctcattgttcaattcccacgtatgagtgagaacatgtggtgtttggttttgggtccttgtgatagtttgctcagaatgatggtttccagcttcatccatgtccctacaaaggacaagaactcatccttttttatggcttcatagtattccctgctgtatatgtgccacattttcttaatccagtctatcattgaacagtatgttttgcctttgtgaaaacacagcatatttttggtgttgttccaggtaaagtctatatcaatatttggataaagaactctttgtaagaaaaaacagcgtgagggtcagatggaaaaaggttgtgggtttttttttttttttggtcttttgaaaatattttacttctctcagctataactttctaagccgaataatacatcgcttgaaatgatagcaagattttctttcatttgaagttctgaataagtccattgacactttgctttgtggttcatgtgcttatagttggcccccatcatttttttaaacctatttttgatctgatgattttctaaatgtatcagacttctttcagagaattaccacttgggctagcaaccaagattaagctgtttttatgatactggattatcagaccattttaatctgggcagaaaggttagttctattaggagttagggtctaactggggccaagctcaggaattcaaacttaagaacacgccagtgggcattatattgtgagccattttttaatctcatgaatccttgtactttgttatagtatagcagtttggctcagtgagtagtttctggtgttttcagggcttgttcctttctgttccctagttctaaggagaagtaaaaaccaaagataatgggcatcattgagccagcacagatatactttagctacctgccacctgaaggagtcagaaataatctccttgactggaaccccatgtagccattatgttcctatctgtgaggctcacattcttgcccagtctgttgttaagacccgctaacaagcagcttcctccacgttgggtaaatccattactggagcaatcactctgtgtcaagcattctgatttcctgagttaataaaatacatgttccatttactcaatgaaaaaatactctggtaaaacccaggttacaattctgatttggtttggtatgctttttcaaaaaagaatgttttcaaatatttgataaaatgtaagcatgtagtgatattttaaatttacttatgttggtaatgaagctaatttaggcaattgtaatccatttcttaggaaatcagtctgttatgaaaccattttcgccatttagcacatatttgaaaaccatgtacagcacattgtatcaggcttcagggcttagaagtgaaaaagacagtttgagccctctccattggcagacaccagcttgcaaacaactgtgattcaaagaatgatatgtgtctgctcatgaaatgaattgaccatgtgagcctaggcaagccgcttgattttttcaggcctgttttgtcactgtgacacagagttgccctagagcaatgcattccaacttctaatgtgcctaggaatcagctgggctctgttttggtaggtgtagggtggggcctgagattacgcatacttaaccagctcttagaccatgccaaaagcactggtccatccaccacattaaaaaaaaaaattattaaaacagcttttttgagatataatgtgcatatcatacagttcacacatttaaggtgtatcgttcagtggttttcagtatattcacagttgtacacccatcactacagtctaattatagagcattttcatcactctcaaaggaaaacccttacctcttagcattcattctgtattttccctgcctctagcagccactaatctgcttgccactgaaatacatgtgcctattctggacatttcatataagtagaatcatacaatatgtagtcttttatgtctggcctctttcatttaatgtaatgtttttaggtacttcattcatgtatgtcattgttttttactgccaaataattttccattgtaaggatttatatcacatagttggtgaatttaatccatttacacttacagtgattactgataggaaaggacttctgttgttacttgttttctatttgtgttatctttttatgttcctcagtttctcctttgtgcccttctttgttttttttccacgcccctccaattgattttttttgatgtaccttttttattccctcaaattattttctgtgcatactgtttacttattttcttagtgattatatgtggattacaatgaacatcctaatcttataacaatctatttgaagtgatactaactttgcttcagtagcatacaaaatcgtacagcccacacctccctcatctttgttatttttgcaaatgacatctttatgcattctgtgcccattaatatagatttataagcattttatgcatttataagtttaattatataggaagcaaacacaggagtcacgaactcaacatacaataatactgacttttatgtttacctacatagttagcttcattggaattctttatgtcttcatatggctttgagttactttctactttcttatttcagcctaaagggctgtctcttagcatttcttatgagtcaggtctgactagtgatgaactctttttgcttttgtttatttaggattttaaaaatttctccttcatttttaaaagataatgttgccagatagaaaattattggttgacagttttttttttctgaatattataaatgtctgctctttttggcctctgtggtttctgattaggattattaatcttaatgaaaattctgttatgtgataagttgtttctgtggctgttttcaagattctgtctttatctttcaatggtttgattataatgtgtttaattgtggatatctttgagtttattatatttggatttcattgagctccttggttgtgtagatttatgtctttcatcaagttggggaagttttcagccattttatcttcagctattctttctgtcgccttctcttttttccttctgagattgtactggcatacctcattttatcatgcttcaaagataatgcatttaaaaaaatatattaatagatttgtggcaaccctgtgtcaggcaagtctgttggcaccatttttccaacagcatggtgcttactttgtatctctgtgtcacattttggtaattctcacagtatttcgaactttttcaatattatgtctattatggtgatctgtgatcagtgatctttgctgttactgttaaaattgttttggggcatcattaacgatgttcatgtaagactataaatgtaatgagtaaatgttgcgtgttttctactgctgctctgcccgactgctctttccttctccttgggctttcctgttctctgagaaacagcaatatggaaattaagccaattaataaccctacagtggcctcttaagtgttcaagtgaaaggaaaaattgcatgtctttcactttaagtcaaaagctagaaatgattaagcttactgaggaatgcatgtcaaaagctaagataggctgaaggctaggcctcttgcctcaaacaattagccaagttgtgaatgcaaagaaaaaattcttgaaattaaaagtgctattccagtgaacacacaaatgataagaagtaaaacattcttattgtggatatgaagaaagtttgaaaggtttcgataaaacataaaagcagccacaatatttccttaaaccaaacctaatccagagcaggaccctaactctcttcagttctgtgaaggccgagagaagtgaggaagctgccaaagaaaagtttgaagcttgcagagattggttcgtgaggtttaagaaaagaagccatctctgtaacatataagtgcaagatgaagcagcagatgttgatggagaagctgcagcaagttattcagaagatgtagctaagatcattgaggaaggtggttgtaccgaacattttcaatgtagatgaaacagctgtatcttctgaataactttctgtatactcgaatcagaaagttagcaatttatgtaagcatctaccacgggataaaattaatttcatatatcgttttcagtaatacgtaacataacacttggttggtttggctttgagtgttagtaagttaaatacatgaagattttaaattacatttttcttcatttgcataaacagtgaggtatgttaatttttgagaacagaagtaagaaattttatcatgatcaggcagctacaggtgaatattttggaagattgttttctggggagagaaatccatttctaatctgcattttaatgatttgcttttaattctagactcgagaggtgattgccttatcagtgtaccgtatgtcaaaccgttctttagcttaagaacttatttgtagctgccagttgttccatattaacctgaatttttaaaagtactttctgcctttcaggaaacctttgtgactggcatttgatttctttctctctagtgttttatgggaataataatcttgtgaattttccaatcatttttattgtgtacatgttaaatatttagactgtggattatatagtcgtcttgattcttatttatattctgatttttgaactgttttatagcatattcacacctccaccagactgcttgaagaagaatgaaagtgaaaatcagttttcttgttcattaacaggtcttctgagggtttaatacttaaacttctggctggctgtcatggggctgcctgattctttgatttcactttatcctacctttccctctctcatgaatgcaatgaataatgactctaatatctttcttctcagacgaattaaattgtgactttattaaactgtaataggcttgcctaatttattaaattccaccttttctttccctctactccctcaaaactacttcctaggaaaactcttgcaatcactattaagagaaaataacttgtgacttagaaagtattcgtattcaacagatagttgaaatctttgcagattgggacattgtaagatttagacaaatttcatgatcatttgagttttagttgcaaatttataatgatataggaaaaaattagggtcctgagctcctttttcttccacatcagcttgtctgttccaccagacaagggctctcttaagtgattgttgttctgaggctgaaaccaaagagctaggttgctgacagagccatgaaatcatgcttttctctttttaaaaacaacagattaaaaaaaaaaattccttctctgttagtcacttcatgttagtatttatccatgtttaagatttacatttaaagcaaaagtcttcaaagggaaaacatgagttttacttctcttacagaaggaattctgtaaatttctacaagtatttttaaatattagtgggtctctttcctaattaagatcttggaaagttacgtgcaactctgactgttgtaacaagcattaaatatgagcttgctaaataaaatgaaccttatataaatttacttgtaattcagataatacataattttttacatatctttgctttatgtgttatactgtctttttctataagtggttacaaaattggggaggagaaataatttgcagattgatcctctaaataattaagaggaatctggagttaaagtctttcaacactggaattttatctgcatagtgttgtacctctataacgttggatgagttacttaacctttcagtgcctgtaaaacagataataatagtaattacttgcctcataggagttgttagtaggattaaatgtgataatttagcatagatatgtagcatagtgcctagcagatggtaagcaatgaaatgtcagctgatttttagtattggcattatctttgaagaagggcccattttaagatttgtttctcttaccttgctaataaatgtgttagtgtgaaaagttaaatagttccaaggttaacgtggaaataaaagtcaaataaatatgtttctttaataaagaaaaattcacttgcctttgaacatgacaggtgttttttaaatcttcagttgcgttaaggtaatgaactcagatttattaactggtttgtgtttgtatacacaattaatgttaaatgcaaaatcctttaaagtctaaatgactattgatctgtattttaaagaataatttttgtaagcttattttgatactaaaatgcattccactgtcatattatctaaacttctgggaaatgctagcacaattttgtctctttggagttatatttattttcatgatgaatattttaaaacttaacaacctattgtaaactgttatttttgcagttatgtttgcctaacacacaaacacaccaagcatgttcctgtccccaaggtctttgtactttttgttgcctttacatgaaatccactctccctaattatggcccagccttggagctctcaggtctgtcagggctctgcagaggattacctggttttggggaatgttttcttctaaaatgtggctctatctttattatgtttgttgttttccctctacctggcattatgttatatactcgtgcttgtttaaaatcactttcccattaatatccaagggtagaaactttgtttcattcactgctgattatcctactgtgtatgataaagcacagggcctggcacattgtaagcagtaataaatatttgttaagtgaatgtaggaatgttgttgatcaaattaaaacagttttgttgaggagatgaagattctgtgaaccaatttttaataatcattttacgtgaggttatttgaggtttttatgctcagaagtgaaccatttgaaaagatgtaatttataacttttcaccccccaccaaaagaaaagaaaaagaagatttaaatttagaatacttggtacatagtgtgaactgagagttaagaaaggcctgattgagaatactgactcagcctaaaatatcagtgatactgtgcagtaatttatcctgttttcttaccaggagcttgctcagtgcctaacactgatagtcagtaaatgtttgttgggtgaatgaatgagcctgtaaaatcagtaaagtcatgaactaattcctagtttcttacagagtatcctaaggacccttgaataaatgcttctggaataaaatggatggaaatttgcaacagaatcacctggagggcttgtaaatactgtctgttaggtttactttttccaccctgtgtttgaggtggagcaaaggactcttaacttctaacaagttctgaggtagtggatgtgatgctgtcctcctttcagaagctttgctgtatatctgtattcctgttgaggtgattcatgttaatgtattgaaggttttgagagcactgcagtagaggaagctgtttaactcttaactatttctgacttacttggccctagtcctctccctcacttgttcgtatgtatgtatgtatgtatgtatgtatgtatgtatgtatatatgtatgtatgtgtgtatgtatctatactcataaaattgttttttttttcttttttctgtatgcttgggtaggtaaatactgtgtcaggagtgaagccttcaaaactgagccctgttgcagagttggaagatattatgatagttatgatctgcatgaaagcatttgtatacatttttgagtcttgcaaattgtaatttggaataaacggcatgtataacaataatgattttatgaaaattgattccaaaatgatgaaatgatttctaagtaacatttttcccctttattcatttatcactttcagtcatcgtcgatggttttaatctgccaagccatatttccagaactttaggtacttgacaaaattaggaaataatattttgtcatgaaaagttgagttttctctagatgaagattgagtcttagctagtgtcaaatttttcctagttgtattttcaattttaggctaatctagtctcatggtacagcattctactttgcatgtcttagattttgttgacttaattgtattttaaaatatgattgtactgattctggtcttttagagtgatggttttgatacaagatgtggctaatcaatggaaaagggatgtttgaggaagaagtgatgatggttatgaactctagagatgttaaatgtagcacaaaatttgaatctgggattctttatgttccctaaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaaggtaaatttttttcctgatttgaaaaaagcagttcctttgtttgaaactattttctcaattattttttgctgattttatgtggaatttttcaaatacatgacaaaggataaaattgaacttaacccattacatctatttgtgaaactggggagaatctgtgtccccaaagtataatatttccgtagttctgctatttcccagataatggataatcctcaatacctgtttctttttaaagagagaaacagtgttttcatggatgtgtttattattaaataaattttaatttagttaatatgatactggctataataatctgactatatgttgttcacctgttgatcgatttcaaatgcttcctttcctgaattctgatactccaccagtgcaaaagacaccattcactaggggtaaaaagaaactatattaaatgtctcctattgagtataatacatgtttgtatttcagaaatactaatataggcaaaaaataggcctcagaattgagtctgctatacgtttttttttgagacggagtctcactttgtcgtccaggctggagtgcagtggcgtgatcttggctcactacaaccttcaccttccaggttcaagtgattctcctgcctcagcctcctgtgtagtagggattacaggcatgtcccaccatgcctggctaattttttgtatttttagtagagatggcatttcaccatgtgggccaggctgatctcgaactcctgacctcaagtgatccacccgcctcggccacccaaagtactggcattataggcgtgagccacagcacccggccagcaatacgtttaatgtaatgtttgtttccagagtttaaatcataaggggcaaatgctaatgacaggaacataaaaaagtaaatttgctgaggaaatcttaggagtgtgtatgttagacatcttcactgtaggtaagactttgaaagttgttggatgtgtgtgtgtatgtgttttggtttacatttcatctggatgtaaatgtattttcctgtttttccccttagggtgttgtcattggaacaggagaaaattctgaatttggggaggtttttaaaatgatgcaagcagaagaggtgagtacttaatatgttaatgatgtatttgttccaaatctgaaattcttcattgtaagtagagaatgttggattattttatatactattgagagcaatattttattcagaatggaaatcagttgtctctgtttagaaacataattggaaagcctgtaattgaaaaggtctaaattgatgttgttagtattctaaaggattttgagctttactcattgtttatagcagaaaaaggcttatagccacttatttgtagatcttattattttcagaaattagtgttgtggtaattttaaggattagtaattagtatatttgtaccttggaatatgtcttctatcaaattttttcaacttcacataattccaagtaagggtggcagggaaaagattgccaagtaaaataacctacaagatattctcggctaaaagtattaaagatgagttcattttaaatactttcttattataaaaagaagcttcattctgcaaatgtcgtgttctccccaaatcctctggatttctcaggtaacctgccaaaactccagtatgcgatgcaaagtgggaactcattccaagaggcgtggcagtgaagggatgaatagagaagagggttagcagttgagggaggattaaaagacctgggttactagcatgtttgtggataccaaaagggaaaaattggaaaagcaagtgagagagcagctgatggtaatgaagtcctgcagtggttggtaggagggagaacagatttttcctcaaaaggaagcatagagagaacggaccttttcaaataataaacaggtttttaaaaatagagaatttctgttcctcactgtgtgaccttgggcattgtgtaaaatctaagtctcagttttctcagtgaaggtgattatttaccttatgggagagttgtatggttaacttaggaattgctttgtcaagcacttagcaagcccctggcacttgataaagcttagtaaatatagctaattgtggtgacactcttcttcaatttatcaaggcaccaaaaacccctctgcagaagagcatggacctcttaggaaaacaactttccttttactcctttggtataataggtaagagaagagtgagtatgtatatatttttatttgagttttgttttttgaatgtgaagggtggtggtattctagttttatttattggcttttcttttttttattaagtttaatactttttaaaattataagactactagtagccattgttcatttcaacaaagaaaaaatagaactctgattcttgtaatcagaaaatatttcttgaaacattttagtatttgtctttctagtcttcaacaagaatgtaatacgatagttttatggactgcttttctatttttatttcacatatcctgtcataaaactcttgtcattaaattgatggtcacataaaacaaacataaaggttgtatagttttctattttgtgggaaaacatataagaagacctcttctagacatttaggattttttgagggtttttttttggtcatataaatacttctttagtgtggtgtcttctggtaaatacctctcttttttaaggaaaaattcttagaaataaaattatttagtcaaaggggatccatgtaacttttaaatttttggccagctttaagtattgtcattaacttcaactgtaaataaaagagttctcattatttgatttcacagttcattattagggaaaccgaatgctttgtcatgtgtgggttgatcatttttatttcattttatgacctgccaacgatttcttttgtcccttttcttgtgtcttgagtcttagattgataaaagctttttatatgactagattatcaatctttttgttgtataagtttttttttcccgtttaagttgcctttgaggcatgtggaataaacttggtaagaggacaatatatgtaattaaccatttatgcctagtgttccattattggaatgctaagcatgtgggacttatttatatcctactgctcaaggtcattgccaaggtctggttgcaaaaattcaaaaaattgcaacctcagacacaaatgggttaaaacatccccttttccttgagattctgttatcaccctcctattgataatctctgcaattaagttggttttgttctgttcctaaagattttcccaacctcatgtttataagaacatttattaaaacattgttgtatagttttttatttttgacattttactattttatttaaaatttattttagtacatggcttaaggcagagttttaacttttttactcaagttaattatcccattaattctgtaatccagtctttattcattggattgaagtcacgtttttatcacacattaagcacttgcattaattttggagtcttttctcctttaattttcttaccgtgttaattattccagctagtttagtatttcaaagtcagtaatacaatttttttatttgagatggagtctcattcttgttgctcaggctgaagtgcaatggcgcaatcccggctgactgtaacctccacctcctggggttcaagtgatttccctgcctcagcctcccgagtagctgggattacaggtgtgcaccaccacacctggctaatttttttattgtatttttaatagggacgggattttaccacattggccaggctggtctcaaactcctgaactcatgtgattgcccacctcagcctcccaaagtgcagggattacaggactaatgcaattttaaagcaatatttctgttaatacaatattagttgaaataactttgtaaatagtaattctgtttatccatctatcttcattgtaaacataaagtagaaggtaggaagttatcttagttatttttgttttactggtgtgtatgccctcataacttcttccgtttgattattgctcattttctagaaattttatagtgaatttgatagatcgaatgacattctagccaattaaatctttgtagtttctattagcactataccataaaccatttcaaatttagtaataaatatgtttcaactttacgatctctggttatatgttagtatattacattggacataatttttcttgccaaggtcaagagctagatcaggggtcagcaattgtttttttttgttttttgtaaagaactagatagtaaatattttagtccatatggtctctgttggaaatactttactttgccattagcatgaaagcaatcatagaaaatatgtaaataaatgagtgtggctatgttccaacaaatttcatttacctaagcagacaggagacccacagattatagtttgctgacccctggtataatcctttggacataatttctttcatcatgatagtatttgggataggatcttagaaggttgctatttggataattattctttagttatataaagatgaaaaaaaaaacttgtcttaaatgttcatattgatttgcagtcttgagatagcttattttatcaaacctctcgtgaatctgtttgctttttcctcacaaacctgcttgtgcgcccctttccccctattcttttcaaagataaaaggttaaagcaaggagtattggtttaattgatttttaaatttttgaaatgccataaaagtagtgatttttagatgttaatgcagttgtaggtgcttaacgtaaggcacatcactttttgagccaagtcgtaagtgtccctttgtgtgtagtatggatttgctgagaagtgtctggatattgtgttatggaaaataaagttttagggtttaattttgcatatttgatattaaatagaagacctatatgtttgctgccaccttctttttttcattgtatgaacatactggtaatttttaaaaaaataataaaatattactgctttaagggatggtaggagcagtgtcaaccaaaagtaaaactgtgtgtgtgtgtgcatgtgtggtgtgtgtgtgcacacatgtacgtatgtgagtatgcacagcattcacattaagcagtgttaactttaacctcccctgtttaatggatttttataaaatcttctaattgtgatctgatatgctttcccttttttgtcaagggacgttttagattccttcagcttgttctgttccttctaggtgattgtatgtaaaagggaaaaataactatttaattatctttcaggaatcatcatgttggttggctggttactgggaaaagatatcctggaaatgtttactattagtgtaaggtaagtctcaatactttataattggagtctcttttgcctcttttatttctctaatggacatagcttacgttttattatggagatcagtattacatggagcccataagagtataacatcgctacataaatagttcagaagtcatatattaaaattatccttagaaaaatgaaaatgtatgtatatggtaatgaagaaaacccatactagatgtctggaattactaatgcattattgcctttttatatataaatatacaattaaggattgtcaaattgaaaactagcaacatgaaagagaaagttcacaatatagaaattgaataatcaatttcagaggaaaacgaaacattgaagaaatgatgacaaatttaaaaaccaagtgtttgtattttcagagacttgtgaagaaactgcatccatgagataaattgttgtagaaaaggatcagagaacaaaaagagtttttagaaattaagattatgattgttgaaattaaaaattcaattgtaggggtgtaatataaattcaaagaggtctccccccaaaaagagtaaaaagtcttagaatgagataaaatgatgaagaggaataatttcaggaaataccacttgtaactaattggagtttcaaaaattacataagatatgacacacaagtattttctcaagctaaggcaaaaagtaagtctttatagattgaaaggattcactaaataccaagcagaatggaaaaaacttcaaccttgatacataattgtgaaactaaagaagaaaagtcaggtcatctacaaaggaagggtaactacgctggcatcagacttctcattagcaactgcagtttctaccacaggatctttttgggttcttctaaacattccaactcacaagactttcacagaccacatctgatacctgtgccctgaacacagcagggtaacttcaggcagccttctcctgagagtccgcagcagtccatgtagcaattcactcaagtacaaggagataaggtcaaccttgtgagtgtgggatctaccttgggttaaaatatctcgtgttctatgagagacgtattttgaaacatgcatttccagatgcctgcaaaggacatgtctagttacaagttactacacttgagaaactcaaagctatgatttcctataagataattataactttcctagtccagagagattttattagtcaggggatcccttaatcatagcagtgttatctagcagcatacttgacatattattcttaccaggtcactaggtgaacagaactagagttaatcaaatccagaaggggaagattattttattaactgttcatccacagcaacatcagattgcattagaataagtggagccgtggtaacaaattaggggggcaattgatcataaatctgtaaattgggcctagccaaaggattggtccaattagtgacaaataggtaggcaagtactcagaacattcatttcctacccatccttatatgaattccagcaaaacaagggtgaaagaaaggaagatgataatagacataagaaagggcaagaacttacttaggcatctaagaaaaagaaatcctggtagacctctgttgtaggcatatgaaatatttcaaatattagaacaaaagtcaatgtctttcaaaaagaaaagtcaaatagattacaaggaatcagaatgaataagaagtaaaaagatatttgtgatatagtgaaagaatgtgtttttttttttctcaagggagggggtgaaaatgcaatttgaaactcttggtttaaatttgtgtttaaaaacgccatgggttaaatataaaatacatttaaaatggggaataagtttgagatattaaacattgacatattatccattggatcatttttagtttttgaggatttgggtttttttttttttgagttctgtttgtacagattgacatatcataacttctgttctttcttcaaggtcttccaaaggacaagatacttaaaaattttcaaatagaataaaactcattctattttgcaattctgttttgcagtatggatccattggaatcttttataagtataagctacattatgggacctttaatgatcctatttttcctctttcttgaagtattttacaatttcttcaccctaggaattattttaacaattatttgcaagagtgctgaagatgactaaaacaataagaaagcagaaaaatgatggaatcattgagaaggttgatgtaataataaagtaaataatcactattctcttattctttagttttcttattgtgttgcctaaagtattgcatcatttaagaaggtgtaaaagaagtctaaaggcacaatctttaggtttgtttgttacagctttcattgaacaaaaatgagaattcagaatttttcactttctactataatggcaaagagaataattgacagagaagacttttcacaattattagacaaatcagaagatcagtgcaaagagccaaatagaagcactgtaggccgtaatgatgtgggtgaaattaataatataagtgaaatctcaagactgagtctttggatgatgatactctagatcttctcaaacaccttaattttgatgagtgagcaatctgtttttaaggacaaaaaagaaacaggtattctcttccagttaatcattctgcagcaaggactctatcatgtagtagttttcagcaagaatctggaccatctcttttagctaaacgaatgcatgaccctatttcattcatcttttatgatgcttgtttatcagcattgacttcatactgcttttaagtggagaaatgctgaaggctggtatgaatataaaagtgattaaaaggaaatagattatgcagaagtagaaaaattcattggattcatcattgtaattggtgtttataaatctaaaattgaaaatgttttgcagtcatggaccaaagaagataactgttctcttttcaacacaattgggagccatcagtggttttagaagtgttgcaatttgacagaacaaatgcaagaaagaagaactagattaataagctagcgcctgttagaaatattttttgaaatctgaaatcaatatttataagataaatatgttccaagttcaccaaaagcagtagatgagcagttagttgcatccaaaagatgttacccatttcaggtatagatgccttcaagtccaggaatagttttgggttatcattaaaatgaaaatttagagtgaagtttttttacaatttaattattcctctgcaaagttttgctaagatgacttaaatataaaagattgaaaagattcgttgtatctagattgtaagtgataatgcctgtttttccttaatggaagcattaaaaaaaaaaaaaaaaagaaaagaaaaaagaaaaaaaaggattccatttgaactaggaacattctctttgagtagcccaaaggagaaaaggaagtattaatgataatacatatttcttgactcttcagtgtgtattgtttagccaataatgttgttgcttatgtgctttcaactttaaaatcaaccagtaaataaagcatgaaaaagtcaattacggttatagaaaaggatgctaatgtactagattatgcaaagaaaaagttggtaatggaaattaggaagtagaagcagcagagggaacagtggtagaatgaagggttaaattgcttatgtccttatttctagcagatcaagaaatagtatttggaatggcacaaagaaagacttgttattttttaattataaaaggcgagtgaaataattctttaaactgtgataaaatacgcatattataaaatttacagttttaaagagttaatttggtggagttaagtatggtcgcaatgttttacaactgttaaccgctatctagattcagaaccttttcatcatgccagaagaaaaccctgtacacattaagcagtcactccccagttttcctcttcccctagtccctggcaaccactcactaatctgctatctctatggatttgcctattctagatatttcatataaatgaaatgatataatatgggaccttttgtatctgtcttttttcacttagcataatgttttcaaggtttattcatgttgtagcatgtgttagtacttcattcctttttgtggctaaagtaatactccattgcatggatgtcacaattttacatttatcagttgatgaatatttggcctgtttccatcttttggctatcgtgaatagtgttgccgtgaacattcatgtatgagtttttgtttgaacatttgtagttatctgtattttatagatgaggacagtaaactacagagctagattagtaagtagcccaggatcacacaagtaagagatggtgaagccagggatacaaatccaggcaatttgatgtcagaacctacattttttaaccactgtgcttaacctggcagctactaggtatccagtaaatgttaactttctcttccttttgagaagtttattttttaggtattgactatattaattttgcgttttattaagctttaagtaacatccaatttaaattttgctgtgagtgctgtttaacctacattttaatactttgtatatgttggttatagtttggctgtagcagcaattcctgaaggtctccccattgtggtcacagtgacgctagctcttggtgttatgagaatggtgaagaaaagggccattgtgaaaaagctgcctattgttgaaactctgggtaagtctgtgttaagagcattcttatgcaatgatgcgtaagtttatgtcaatagtgaatcatctcagagttttacagtttttatcttagagatttgcataatgatgtttggcttatggcaaaattggatatggttttaacaaccaaaaaaggcaattaaaaattcctatcccttaggtgaggggacttgaagagaaatctttctacatcatgttctaatgcacaaatcatgttaagaaaatccatacaacaactgaaatcttggagtaaaattaatagaatttttttcttgtgacatgtcaaagaagataatgtattattacagatcccaaatgtcatacttgagttgaatttgcctgtaagaacagtaaatttacagtagttatattgctgtaacaaaactttatgtgcaatatgctttgaaactccaaaaatgtactgaatttaatttctagtttgtattttaatatcttctccatatatgagaagctgaaataccttgaaaaatcctgattgaagaaattatacgggtttatatttagaaactctccaaactttctagaaaagatgttatataagatcattacataaagctaatgtgaagtagctttgtagaaactaactgtatataaataagaacatgtcatcatctaatttttatttttaatttcagaaactgtaccttatgctgaaacaagcataatgagagaagttaatctaaaattaacaatgagtttgatttctataaaattcagagaagtaggacaggattctagtctttgatttgttttttaagtgaacctatatttctccttgattcttttggtgacttgtaatgatttaattctttaggctgctgtaatgtgatttgttcagataaaactggaacactgacgaagaatgaaatgactgttactcacatatttacttcagatggtctgcatgctgaggtactctataggtttttaaaaacaaacaaaaacagtatccctttaagaaacttggtgtttaacattcctaacagttccagtgtcttaccttcaaaagggctgtaaattagtagtggagttattttctctctctgtgattttaccaagtctttgtctcattccacttgtacacttgttcaatccaaaaactttgattcctccttgacatctctctttcagtcaccccttcatctatccataatcaaatcctaccaattttgacttcctaaagaattttcccagccatctactttatagccagcttctttaagttaccgccatttctcacctgccattctgataaagctttttgactggtctttttccattcttgatgccctcactccataagcagtttgagggatctttttagaaccaaattttaagcatgtcactccataaattaaggtactccaatggttttccattgtgatcaggatcctgaactgtggcgtctcaaagccgtacatgttctgtcccttattttctcctctacccttatatgctaccctttgctttctgtgcaccaagtatactggctttatagttctttcgatgtgacacaattattcctactttaagaactttgctgcctttgtcactgtttaggatagtctaatgcctcttcatcctttgcaccttaattccaacccacttcttcagaacacccagaagtggccctatgttatatgttgtcttagcatttcatacctcttagtccttatcttaggtaaaattttctgtcccttttccccattataagagagcaggagctatattgcctagcacacagcctgcttcatagtaataaatactcgataaatgaatgaatgaatgaatcactttattttaacaattatatattgatacattgtctcttaagtgcacatcactgtgcagtagttcttcctgaaggtgcttatggacaggtctaatcctactcagtctatgcaggatttctgactggaatgctcttaacactacttatgttgggtacagtgatttaaaatgtatttatagctaattcattgagaaaaataagcagtaggcaaattgacagaagttgtacttgggtttatttacgtccattttacataggttttgaaaagagactcttgatatttacggtgttagatctggtcaaagatcccccatgctgtgttggtgaatgtgccctttctggatgattcagaagggtcattgggattacatgtgcttatatgatccaggtatggaaggtagaatattagtttttcttttgttttaaggtcatgctatatgtaatgcattaactatttgttaattgttttatctctcaattaatgtcattaaacattttttatttatttttatttttaatagagatggatcttgctttgttgcccaggctggtcttgaactcctgggctaaagtgattctcctgtcccagcctcccaagtgttaggattacagatgtgagccaccacacctggccactaaattgtatgatttttattgtgaaatttcttttcgtttggcttggtttgttctagacatatgatataaatacctggtttgtctctacctctgatttttaaaattggtgtgtaatatgctgtgttaaagtgatttgtaagtgctagcatatatctcaatgtctccaggcctgcatgtttgcaaaaagaatactgcttttgtctaagtcacagctttgtgttgtatgttacatatggtaatgcatttgagttctttgcaaactgtagtatgctatataagtgtaatgtcatataagtttaagcttacttatgtatattttcatagcttattcttttaacagtatattgtaattagaaaacaatgtctttttagattaataattgtgatgagaattagaatctatatttctttactaaatgtcctttttaaagacaaattttaatgcttttctaggtgaacacttttaacagtgtcattataaataaaatgaacagaactcattatagtttttgggttttataggtcttgtcaccaccaagtgtttgtagtgtttgtattattgatcccactttgtgatctttaggttactggagttggctataatcaatttggggaagtgattgttgatggtgatgttgttcatggattctataacccagctgttagcagaattgttgaggtaaatatttttttttccaagatggtgactttcttcataataacttaagacacagtgataggttcatagtttatgtgtatttttcttaggcgggctgtgtgtgcaatgatgctgtaattagaaacaatactctaatggggaagccaacagaaggggccttaattgctcttgcaatgaaggtacgtacctaaatttctcttctttgacatttgagacactgccctcacaacagaatgcagtgtcatcaatttcagtattactggtttttaggtattgagtgaaaaaaactcatactatttcattgtttttactatcttttaggtatcagttttattcctataaatgtaaagtatagacttttttcagtataactttattgttcacatgcaagttacaaactaatgagcagtcattgatttcttgtgaagaaatgttcctgtcttccacaatgttgagatctacatgtgaaatactttataaatgtgtgtaattgctgataaatactaacttttgaatgaataaaaggcaacattctttagtatttctatgtaaagataataacacagtcatgagaaaatagctttgttttcccagtctttcctttctctcctttgttaatttctcaaaatgattgtgaagttataatttgttttggggagaagaagtctcagttaacttttcatctgtcccaatccgtctccttatcccctaagtcctatatttgattcagtgagaaacctagtaagtccagcctgtcactcataacaaaaataactattcctacctttaagagtattcagagaaaattttgatacttgtataaagcaagaggcttctaaatgaggttgcttgaaatgagagacagtacagaattacaggttattataacatatttaatgaaataaaattgatagttttagaatatatagtttccttggcagaaaagcacatttctgtatcatttggtctccttacaactaaaacagcatagtactcaaaacatgaatccgttatcaagtatttcctgtgttatgcttataaagatattagtttctttgagggataaagaatatgaaactatctttttatgggcagagacctcacattttaggtagggaatttatattgacattcttgagacaaaaggcagtccaagacagcagacactgaaatcttaaacactgagtcacatataagataagaacaatgcaaattcagagctgggatatgagggctttgaaggataggaagggtttagatgagataagctagggaatgaactaaagtagaagtagagaggaataaaagagcatagagttggttgtggctaatgagttggccaaactggatgaaatgaaacgtatttgcacgaccaggaggatttttatagacgctgtatgtggtgggtttctggagaacctttaaggccaagaagagcctgaacatgtttcagtagaaagtagaaagcaatacatggtagaattttgagtagtttaaacatttttgatatttggaagatattttttgatatttttgatatttagatatttgatattgatgcaaacgctattaggagggaaaacaacaacatgactggtagtattcaggatataaagtggcagagggtaagggactaggatgataacaggtgagccatttgagtccctaagaagtgagagatttaatctaaaacttctattgatcataaaaatacatgctcagaattggttgggtacttttatttatttatatcctgcttcctttcagaatttgagtgggtagagggattaatacagtgtgtatgggaggtttagtcagcgtacaatccagaaaacctgccttagactatatctacatacctgggctttcatgttgaaaatgtatgctgatgtgtagggaagtacagtatatatagatggagcatttactatttcactattaactgaaaaataatccagccaacctagttacaagtggtgacccttgttctttgttaaaggaaaaaataatcacatataggtgagaattaactttctctttgtgccatatagatgggtcttgatggacttcaacaagactacatcagaaaagctgaatacccttttagctctgagcaaaagtggatggctgttaagtgtgtacaccgaacacagcaggtatccatctgtttaaagaatacttatttcctgtttagcttagatgactattttttcatttactgtccacctttgggtttagtcattgtacataataaagacttgttgctttaaagtacatgtaattaatagtacactcatctcttaattgtttgtgttctctttgatagtctttccttatagaatccatgcatagatatattcatggagttgctgctgtgtgagcaaacagcttaaatgagttgtagcctagtctcagtctcctgaagcttgtgacatcagattttttcagaattttttctcttcttcatgacagttccttataaggtctttgcagactgtgtttcaatctgtgttctttcactgaaggaatgtcttatctttagaacaaatgaagccaccttactttttgaaaagtagtttgcaaatgtatgtcattcatgttgattactccagcttacaagctgacaaaatgacataccgatattttaagccgccaccttgttcctgggtgcttgagaaatttttccagttagtgtaataagagttctgaattatctacagtgtataattatatcactcatagttgctattaccagcttgatgatgaaacttaactttaaaaaatattgaagcttgggctggatgcggtagctcacgcctgtaatcccagcactttgggaggccaaggcgggtggatcacctgaggtcaggagtttgagaccagcctgaccaatatggtgaaaccctgtctgtactaaaaatacaaaaattagccaggtgtggtggtgtgtgcctgtagtcccagctactcaggaggctgagacaggggaattgtttgaacctgggaggcggaggttgcagtgaggctgagacaggggaattgtttgaacctgggaggcggaggttgcagtgagccgagatcaccccagtgcactccagcctgggcaacagcctgtctaaaaaaaaaattacacacacacacacacacacacacacacacacacacacccttaaactttccttcactcttttgcctaggctgagtgcagtggcgtgacctcgggtcactgcaacctcaacctcccctggcacaagtgatcttcccacttcagcttcccaagtagctgggactgtaagcacgtgccaccatacctggctaattttgctaattttttgtagagatgggatctcattgtgtttcctaggctggtcttgaacccctggactcacatgatcctccaccttggcctcccagagtgctgggattgcaggcgtgagccaccatgcctggacttatttgttatttttatagttcctttgacaggaatgactagttggttatatgtttttacctatgagcaaacacatgatttttgcatgtgatacctatgattacgtctctatagaaaacaggaatgaagggatctcccttcattcatataagtggaaacatacagtttttaaaagaaaggccaggttggttaacactgaactttgaattgaagtcttccaggaactatgttcatgagggccaaaaaaaagatttccgtctattctttaaaggaacttttacaagcttaggtgaaagaagacaattggaaataaaactatgaaaatacaatacctttcactttaaacgttttaatgtaaagctttcagaaattgcattaaacttaggcgattttcagctgatgtcccttaaccacatagttatatggcaagcatatgcatatgactttttttgataggtctatttcattacattttgtaaaccatcacacggtacctcaagatagtgtggctcatgtaatgtttaataattttacttttcaggaacttttaatgtaatctaccaaagttttacattggaagattaaatcttcttagttgtgggagtgggggacagaaagtggcaggatatgtttggaaacatttgattattcttcacacttgctgacctgaagagttcctcttgcaagtgaaaaccaaccagtgaaatgaacaaacaaaacccaacccacagatgtgactcaggatctagaagaagtcatcctgacacagatagggaaacttaacattttaaaagtaacttcagtggctcagatagtttgcttttaaaggactttcacttgaacatgacaatatatatttatctctactatctccctggaacccaccaaaattactaacaaggaataaaagatataaactcagaaagtatagggaagattcaaaggtgccaggtacctttgaaggcagggagtaaggcataaggctaaaaatagtagagaaatttgaaattctgaataaggaaccaatagaactcccccaagtacctttgctgcttctttaggccagacggttagccttcctttacccctgtggaacaccagaaatctggggataagagtagagggtaggattaagccttaagactgaaaacagaatgattaagaagatgtcattgtcctgaaggataaagccctagttcttaacaccatttgtctcttggaatacatgaaggctggcatctccctactgtcattccctaagtaagaagattcaagagttttagaaaagctgcctggtctcgtaaggcagtggtccccagcctttttggcaccagggactggtttcctggaactcttccacaggcaggggatggttttgcgatgacactggtccacctcagatcctcaggcattagattctcttaaggagtgcacaacctagatcccttgcatgtgtagttcacgatagggttcctgcttctatgagaatctcaggccctggctgacctgacaggagattgagctcaggcagtagtgctctcttgcctgcagcccacttcttctttgtggctgggttcctaacataccatggactgtactggtccactgcctgggagttggggagccctgtcataaggggcacctttgagctaagctctttgttcattggaagcacttacctactcctggacttcatctcatcaccctacagcaaggcttaccagttgatccttagctctgccagtgctcatggagcttctagtcttttagtttcttcactcttttttttttttttatatactttaagttttagggtacatgtgcacaatgtgccggttagttacatatgtatacatgtgccatgctggtgtgctgcacccattaactcatcatttagcattaggtatatctcctaatgctatccctccccctccccccaccccacaacagtccccagagtgttcttcctgtgtccatgtgttctcattgttcacttctcatctatgagtgagaacatgcggtgtttggttttttgtccttgcgatagtttactgagaatgatgatttccagtttcatccatgtccctacaaaggacatgaactcatcattttttatggctgcatagtattccatggtgtattaaatacaagtgaacagggagggattactagatacttggagaaaatctttagtatgaaagccaaagaccaaaccaacagagaaagggatcttagagaaaggtagtggcagatgctgaagaaaatttccaaaaaccataaaaaagacaaaataactttcaataaaatgtttattaaataaagtcaagaaatgtatcaaagtagaacagaaagtcaaagacatgtacagtataaaaggtaaaaatcaaaacaaatacagaagatccagtaattaccccatagtggtaataggaagggtaataggaataggtaataggaagaaagaacagaaaatgagaagattttatcaactaatgctggaaaattttccagaatgaaaagactttagcatctagaataaagtggcccaccaactgctcagcacaatatgtatgttaaagcagagtggggtgagggataaacacaagacccataattaagaaatttgaggacacttggagagggagaattcgaagagcttctagagagctttaagcaaaggggagatcatataaaagggcttaggaactaaagtatggtagtctgccacttagcccagcgggatacattccaagactgctagtggatgcctgaaaccatgaataatattgaaccttatatataccgtgtttttttcgatccggtaacatagatggctactaagtgattaatgggcagggagcatatacggtgtggatatgctggacaaagggatgatgtccttggcaggacagagtgggatttcatcaccatactcagaatgttgtataattggaaacttatgaattatttatttttggaattttctatttaatatttttggactgctgctaagtaacagaaactgcaggaaattaaaccctggataaggggacactactttaatttctttatacttttcaatgaaaacattgacactggaggctggaagataatagagcaaagccttcaaaatgagaggaaatttatccctagctaaacttacaaatgtgaggatagaagaaaaatgtgtcccacaccacacaccctttcttagatattggtggataaaagaaaaaaaagaaaagggagacttaaaagacttaaaattcagtgaggatagaggtagagggttgttcctagataccagtggtacagcaggcctagaaatcagccaattagaaatggaaagaagactgaaggagggtggtctccagtaataatatagaggtaatagcttatctgcttctttgttgttgtgaaaaaataccatgagaagggttttatattacattgaagagtttaggaagaatgaatgataggtatacagaaaacaaattaaagaggtggttattaactttataaaagacaaaacttgaacaggaaaagaagtatcctatttgagctatcaatcaggataggccatgaaaacaacatcatgctctcctgctgcctccctgtccccaaatatctgctcattgtagttacttgggaatgcaggcagatggaagctccattttaatgtgagcacacactgtcacagcaggggtagaagaataggaaattgtgcactggcacctacatttccatttggaagtgacacaagtactcatgtttattggccaaagcaagtcatacctgaccgttgtggagtgaggacggcaatagggaaatacattcctgcctcccaggagaactgggatatttgtgaactgctatagtcattaccacacttggcttagcagcaaagagtcttgttgtaaacaaaatactggcagattttgctttagctatatcataaagatggggagggggggaatagatagtggaaatggggaaattaacatctgtcacaatagacagtgtataaaattgataactgatggagtagcagtataaacatgttaaaaacatgagggtaaatatcagagaaaacagctaagagagttaaaattattttgcttccatggagtaggactagtggtgagaagcgttgaacaggaaactgcagtatttcattataagcttttgaagattatttaccatgacaaaaaataaaagaaaaagtgcgataatacccataaatacagtgtgattgggagaattaaatggtgttttaggtagatagatatagacgtatatagtagctaatagagaacttgaaccattgtgagctgttatttctcttccatttcctgttatgttgcagtgagcctctttccacatttcagagtgccaaatttggggcttagtatagcattgccttttatgtgtgggatggtgggatagatgttttctatagaagatacagaaagctcccctataggaatatttaatcttcagagttcaggtggcagtcaaaaccttaggcttgagtaacttctctgggaattatgagaaatgaatgccacttaattttggactccaatggcaggtaagtacaagttgaaattaaacttgtgtttggtacattttcttcttaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagaggtaaggctatttcagcatagtcccctggggtggaaaggtagagccttcttttaattgcagatgaattcatgcttcacatttgagctgtccaactcacttccaggatttgtagaacccttgccagtattgaggtgttaagttttagttggttaattggccctcaaaagatggaaatttgagaatgtagcaaaatatgaatcactggttcttttagatctccagaggtctctgagtagctgatagaaattttattttaaacaagtttatcttatgagaagggaaatggatcgaggtaaaatggtgttactctctttttatcactttgttttaaagacaaaaatacttttctaaaaattgagtctgaagcctctaatatatcctttaaggtgattgctaacttgatctgttactgttcaccagggaggtaaagaagtccccagattctgcttacttatatgctgctgactgagcagtgatggggagagggtctgctggacacacacacattaggccacctctcctagggatgtcatgtgtaagactcgggggttggtggttggtgtcctaacctgattcttaccttctggatagtcatctggcttctgcagaatatatgtagttatgtagtctctcacagcagttggaagagttggcttccttaattttattattttaatgaaataggagtctaagcactacaatttctgggaggaagaaaaacaagttatgtgaaaaatgtttttatttgttgttcacttaagcaaaggctttttttgagttttaaacattttgatggatttatagggcttctgttcttaaaataaactaagtttggaaaggtactcttaccagcagagaacattgctcccagcctgctgccattgcccttctctctgaaccttctgtgctgctgaaccaagatcactcctcatacccctgcccccagagcctggtgcatctcatctgggatatgggctgtattgtgaccatcttaacacttcatcccctgtctccaaggaaatgggaggcagagactcatggctgagaagttattttgcaaatggatattttggatggaaaaaaatttaaaggaaaacaacttttccttccccctttccccttttaatgtaagaggctttgatgacaggttctagagtttctggggtttcatcccaaaggcctgaatctggaacatgccctggatccccccacctcagtcctcaagctttctggacccctgaagccaaggcagattctttctcccagcgtcatttctggggcaggaggaatctcttttctggtttacctgggccagacctaagaatagcaggatctctgaaaccacagggttttgatgtgtttttatcaagccaaatgtacaattgccaactgacactctggataattgagcacagggggtgccctcgtacattgtaccgtcactcccttctgaacagttggcagaccaaactgtttggaagctcagatactctggctcagggtaacacttttgttccccttacactcctcaactttccacctcagctagggaaagagaatgacagttaaggcttgacccaggattataatcgttagagcaagtgggagtttcagagacttaaggggcactgcagggaggccttgctgccacaaaattagggtttggattgataaagcctgtgtcggaaggggcagtggcagctccactgagacaatcctgggaagactgtggtgcagagggcctgttactcccctgattcacctgattctggggctttgaccctttctttttaaatttacttttgctaagttgcacttatttattttttaaaaagaccgttggtgaacaaaatgtgaacccatttctttcctcttttgaacttctgggatgtcatcacttccagtttgttggctttgtttccagctattaataaagcattaaaagagtggagaaaaaaaggtagggaagtgggcagagtcttgctactcttagcagcacatagcaagaggttttaaagtggcatggatttagaggacttaaagaggtcttgaaggtctaatatatgctccctctttttgttagtttctggaacaaagttttcctacctcattatattgactaattcttttcatatgaaggattgtggaggtttgtgtatgtgtgttttgtactgtaacattatgaagtagaccagagttggtagaggggaaagtttttgttgcacagagttttgggaaacattctgctcatttgtctcttgcttcatgtcttttcttctttatctacccttgtgctccacttccatcctccccctgagattaccgtaatgaagaacagaaagattttaaacctcagttgatatgtacttacattacatcttatgaaacaagtttcttaaaatactgtggttcttaattttgatattagagtatattttgttttatgtcaggggctctccacatgaaaaaagtttacctatccttgactcagagagtagcagcagattttcactggtgctaaagaagcaaataaatacaggatactaacctctagactagtgccacccctccattaggagtgcgcagagctgatctttccgtcttaggatttgctgacatatatttttgtcactgtccccttctgttaccatcagcctctatcctaacaccaggaactgtgaagtggctcattctctcaagggtgaaagcctttggagcccacatctacataaataattaggtatatgactcttactttggaaaaatagaattacttgcttttaaccttgattttttttgagcatatgtaatctttcataccttctgcttgacgaagaatggatagtttctttggtctctctggggcttttcagtctcctcttgacttatttatgtttagtttgtatgtgcatgttacaagttgttcagtctaatatctcagatgcaggcacatccctttggttaataaaagtagtttccggagttccataattctgagagcaagctaaatgatatttgggaaatgaaaagtactttgtactatatcttacatgcccaaggatgatgacagggaaataagtagaaataataatatgatggcgttatttacatactcttagagaaccaacgttacaaataagaaatgtctgttcatgttatggaaggagtaaaagaatccaaactattgttggtattaatggttttacaaccactttccaaattagctttaccttccaggagttttcatgtacaaagttgttacaggctgtgtataattaactaatacagccttctcttcagagtgtttaatttttctggagatcttggaaatggaaagatgaagatccgttagaagccaccttcaaaggtgtttgcctgtttaaaattgactttaaagcctaacaaacccatagtttctctaaataattaattctattttttaaagaggtagagttcctgttgaaagtagctgcatgtgattactatgtgaaaatattgttcattttctgtctcttgcctactctgcccttcagttctttagtttgattctttttaattaaaacagcttaaagggaccccttatccagaaccattaaactataatgttttggtctgtaatcattttgattttacaaatgacattatagtcttaagtgatttatttaagaagtgttactgtctccaatttctatcaactaaattctgatgttttcatgactcacttttttttgttgttgtttggattttattatttcctaagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcggtataactagactgctttcttttgttttcgatagtttttcttaaaatactgtggtgcataattttgtgaactattagttatgaatatgtttatgtaatattgagattatgcaattgaaatcgactcatggttttgctcatggtctatataaagttggcaaaactgattatagtttaaaaagtaataactttgacatgcataactaaatcatgaaatcacatgcattttattcacagaagggtaattatttttaatctcatgatcaactgtgatgacagagtaaaagcactagatcatgattgtcaaaggaaacatgaaacttagtttttcctttcaacttaagtataattttcaaagcagacttgtgcataatttggcagaaaatagcttgttatatgtatttgtttttcatcatgtatacctatatttgaatgctatttaagattaccgtaagaagtagaataagagcgaagaagagaatgaaagttaatttcccagagcctctaaactgtaattcatactgataaatttaacagttggctaaactccattaattcttatttggagaggggctagtccaggagtttcaaactatatattgtctaagaacaggtcactaggaacattatattattggaagaataacttttcgatgtttattttcatttatgtataactacatgattaccacagatccaccaccattttgtctggcttcggacactgtacttaaaatgcactctgatcttcgttacatttcagctgctgagcagaacctgattggcctagtttcgattcttaggtatgctagcttaaatagtcaaaattctttttttttttttttcctgtagagacagggtcttgctatattgcccaggctggtcttgaactcctgggctcaagtgatcctgtagccccaaagtgcagagattacaagcctgagccaccgtggccagccttgaaaattctttattcttaaatttaaacaaaaatgaaagtcaaacataaaactccagacttaatactgattcagataggtttgtattactggtaggtaacaaaagagaacagataacaaatcatactaaatgagcattacgttgactagcctgtcaagcaaaaacaatttggtttattacattttctctctcatttgctttagccagtcgtctgggattgtattccaaaacttcccagtcagtctcaggagaagaaatagatgcaatggatgttcagcagctttcacaaatagtaccaaaggtaggcctaaactaaagccttttggactgaaaggccttattctaagtgttaccatttctactactatcttaatgaaactgtttaattgtgaacatcagggatttaaataaccaccagatttgttggttcaaatcctgaaatgaagtcttatcattgaattagtcttatcattgattatttatgatatgatgtttatgaatatcagtgcaaaattattaattttagcaagaaccagatttcctctgagaaaagtactgtggaaattaatagtgcttgtatttatgaattagaggatggagagagatcattgatttatacttcttactcttttgttcaattttaattttagcatgagtatgtgattttttttaggtacaatttacatatagtaaaattcgcccattttagtgtatagttctgaacattgagtgatgcatgcagtcttgtgaccaccaccacaatcaagatatagaacagttccatcatccccccagattatcttaggcctttttgtggtaccttctccccctacttccaggacttggcagccactaattctttttttgtctctgccactttaccttttctagaatgcactaaaaattgaatcataccatatgaatgaggcttttgaatctgcttctttcacttagcataatgcatttgacatttatctatgttggttgtgtgtattagtagtttgttgttgttttttaaagtaatattctattataggtgtaccttacctattcaccagttaaaggacatttagattgtttccactttttgatgattatgaataaagatgctgtcaacatttgtgtacaggcttttgcagtttgtacacaaatttattttgcatgaaaatacattttcatatctcttgggtaaatatctgtgagtaattgctgggtcatacacttaatgtatatttaatttcataagaaactgccaagttgttttacgagatggctttattattttgcaaccccaccagcagtgcctggaacttctaatagtcctgcatcctcactagcacaagggattgtcattgccctcctcccccattctgataagtgtacaatggtatcttactgtgattttaatgtgcgtttccctcacaactagtgatgttgaatatcttttcatatgcttatttgccatccatatatcttctttagtgaagtgtctgccctgcctattttttaaaaattatgttttctaattattgaattttgagcattctttatataatgtggatacaagtcctttattagatatttgtttgaaaatgtttctttccagttggtagtgtgtcttttccaagagagaagcttttaattttgattaggtctagtttttcaatttcttcttttatggactatgcttttgatatctcagaactccctgcctaacccaggttcacaaagattttcttcgtgttttcttatagaagttttatagttttgggttttatacttaggtctgtgatccattttgagtgtatttttttgtatatgttgtaatgggttacggtttattttctttgcatatagatgttcagttattccagcaacatttgttgaaaagactgtcctttttccattgaaatactttttaacttttgattataatgcttttctaacaaattatttgtaggaaggaggtatctcctgccccacagcacagtagcttctttaaagccaggttccctgatatgagattaacttactttattatcttgggctgccttgtaaggggcctatcaaagcctggtttgtggatacccaggtcccataggaagtgccccataagaggtgggcagcagtcttcccagttgctgacagttcagatttcttggttttattgttagttaacttatatatgcacatctatttgtatgtccttcaaaataagcacttatctggaatttattttattagctattttgtagccatccattgttactaataaaatgtgctacctcctccttcatttattttacacttacaacttcaagttatatattcagaatgtggaattttcttaaattgtttctgcatcttaaggtatgtctatacttttttgattagaaaatttattcattagtggtatatgttcaacatagaaaaatcaaataatatagaaaagtaagagctacaatagaagttgtctgtaatctaacccacactcaggttatgcatccacagagtatccataataagttaacctattatgacttaaaaaaatgtgtttaacaaaacctggttgctactttatactgttataattctgaacattcattttacataactttggcatttctgaaatcaattattattagaaaacatgtttttaattgctgtacaatattttgagtataccatgtgtatgtgtgtataaatgcatagcatgcatatatatatatagagagagagagttacataaccattttcctgttgaaatttgagcttctattctttttactactgtaaatgttcctttaaggataatgacaatagcaaccatttattatctgccaatgcatgtattacctacattatctaatttacttcttatagctaccttatgaaagataggcagcaccgctttaaaaattctaataattaataagccttatttcttagcagtgttagatttatagaataattgagcagataacacagagttctacattcctactccatctctaccctctactcttacacagttcctcttcatattaatagactgcattactgtagtatatttattgcaattaatgagctaatattgatacattcttatttcatggtttacattaaggtttactttttgtgttgtacctttctaggggttttgacaaatgcataatgacatatatccaccattacaatttcttttgagacggagtctcgctccaccattagaatttcatacagggtagtttcattgccctgaaaatccctgtgtttgacgttttcatccctccccactccgcttgaatccttgacaaccactgatctttttactgtctctgtagttttgccttttccagaatgtgtatggttggaataatatcatatgtagcctttgcagactggatttttttcactaagcaacatgcatttaaggtttcaccatgtcttttcctggcttagtagctcatttcttgtgagcactaaataatattccattgtatgaaagtgccacagtttatcacttcaccttttgaagggcatcttagttgcttccaggtttggcaattatatataaagctgctctaaacattcatatacaggtttttgcgtagacataagttttcaattcatttgggtaaatactaagcacagttgctgaatcagatcatatggtaagagtatatttagttttttaagaaacaggcaattccatttttatagatgaggaaattgaggcccacagtacttgggagacttggctgatgtctcagagctagtaagtggtggtgttggcattggaactggaatccaggtctgtatgctccagagttcatctgttgtttgctgtttctttgaatattattgaacctaagatgtacccaactctgattattattattattgttattattttttaccactgcccttatccatgtacatctgattatttttatacactaaattcctgcatgtgaaatgattggactaatgttcaacacatttgtaaggccgttaacatatattgctgaattgtcctctgaaaaagtttctgtttatatttccataaactacacttcatacagtagcattaagtccctagacctccagccccacttccctcatcctctagcaagtggttagattttggatgttgttactaatagaaatacactattttgcttatccatattttttatttctcaacttctaatcactcatgaatgctgttttcagagagagccaatcatagtcctgaaagatgtaatctctaatgttgaaatcctgaaagattgaaatccataaagtcttaaaatcctgaaaaaccacagtccccaaagatcaaaatcctaaaaatctaattctggaaaaaataattttaaaataaaataatttacatttttaagaaggaatttatttgagaaacataaaaacatgaaaatgcttcattggtcactttatacaaaataagcaataataaataacctacatagttttgcaagcatttgcaagcataaacactcaggcatattatatgacagaaagatataacataggactgttatgagcatatgaactgtatttataaagaaataggtcataagggaaatgcataaacacctatcactgtggttgctaattgtgtgcaccccactttataactgtgggtcatttttatctttcacaaatgcagatgtatgaaaaggacatctgttcatttattgaggaagtttcaacatttttacatacatgtacagtgcttacatacaaagtcaacattgtgatcatgcactttcgtgaagtcagatttgcaaaacatgcataaaacaaattagaatcctttaagtctctataacttacgcttccagtgttggaaatgatgcaaaggtgaaatacatagcatagcaaattgtaaaaaataatactcacaatttaaaatagcggaaaaggaaactaaaaaaagaaaaataatggccgggtgtggtggctcacagctgtaatcccagcactttgggaggctgaggtggatggattgcctgaggtcaggatttcgagacctgcctggccaacatggcgaaaccccatctctactaaaaatacaaaaattagctgggtgtggtggtgggcgcctgtaatcccagctactctaaggaggctgaggcaggagaatcgcttgaacccaggaggcagaggctgcagtgagctgagattgcaccagtgcactccagcctgggctacagagcaagactccttcccccaccccacctcccccgccccaccaaaaaaaaaaaccaaattaacaacaacagcaaaaaacctaaaaagaaaatatgacatggaaaagcatattacagagataaatgatggacagttgcatggagatagtccataaaagctggctgactttcacgatcattaactatattttgaagtcttgcagcatgatgagtagttgcttttttttctttaagaacatggctgtcagcgtatgttcatattcattttctatgtggcactgctgtttttgaaattctatgattcgatgtacactaacatgaacattctctattaaattttcctatcctgtgattgtgattttcaggagtttagactttagggattttgatctttagggatttcagcatttgggattatggcatttggtattgcatctttcaagattatgatcccagtatgttgggatcatagatgactgttgggatcactgccacccagagagctggggcagtgtggatgtttgctttgtttttggggtggggaaggtgtttatatatttgaatagggctttttttttttttttggtgcacgtcctatcctggtaatctcttcctgaagtttatttctgaataaatcccatattggatttttttagtggtattgggacagagtattagtaaatgtatgtgaaatctgcagttacttaaacattttaccattagacttctgcataacttctcagagatgctaaaggtggtgaaactttcattttatttgctttcttcagtttgtcctctggctctcttataaaaattaaggtgaactctggaaaccaaccaaagatagttagggaagaaagaaactaattacaaattacatcatcagcctggacaaatcacattgttggggtttcccaagtagagtgtgtgtgcgttaattatagcagatatcctgatgctattccaaggagactaaaacaaaataagacctaagccctgtcagaagctcgttgaattgcttaaattcatcctactttaaagtggaattctataaatactagccctgcctcccaggtattttgtatcttttgaatacctaagtcttttctccaaatattattagagaattttttgtctcattaggttagcaggacggcccccaccctcatcttgtctttttccctacttcattttgtgttcatgtgacccttttatagccaatatgtttatttggccttcagctttttgattagtttagtttagtttagtttagtttagtttagtttagtttagtttagtttagtttagttagtttagtttagtttagtttagtttagttttagagatggtgttttgctttattgcccagactggagtgcagtggcatgatcatagctcactgctgccctgaattcctgggcccaagctatcctctgccttagcctcccaagtagctggaactgtaggtgctcaccactatgcttgggtaattaaaaaaaaaaaaaaagaaagaaaatccatttctgaatggatttttaaacttttttgaaagaaaggatttgcagaaatggagtctcaccacgtgttgcccagactggtcctgaacttctgggctcaagtgatcctcccacctcaacctcccaaagtgctggggttataggcatgagccactgcacgtagcctcgtcttctgctttcctttgtttgttttttgagacagagtctcctgctttgttgactaggctagagtgtagtggtgtgaccatagcccactgcaacctcaaactcctgggttcaggtgatctccccagttcaggtgatccctcatgactcagtctcctgagtagctgggactactggcatatgccaccatgcctaggtaattttgttattttttatagagatggggtcttgctgtgttgcccaggttggtctcaaactcctgggctcaagtgatcctcctaccttggcctctcaaagtgttgggattacaggcataagccactgcactcagacagtttgctgcttttgcttcacatcagtttgaataacttttattattgttacaaataaaacagaccttttgttctaaatcattagcttgttgacattttcccccatgtactagaatcatattaattgtgcccctcattaaaatatttttcagccatcctttttcataattcttttgaacacatttcattctccttttggaatatgaagtgttgctatgtactttgacctagagccagttaaaaagtagtactgaatctcagttttgcttgttattaagtcatctgggaattctcagtgttttccatttatgactttttctagtgtgtcctacattttccattgatccattgatagaagtggtcatcctctttcattcttctttttctgatttttacagcattacttgcatttatatttctactgaatctattcaccaagtccccatattattatcacaattcatatagtctaatttttaataggttgtaaacctttatttcaatcacttgttttttcttcagtgcattagttttctttaatctgtcctagaagatttgaggatcttcggtaggttattctaatgcaagacacatcttttccattaatctctcctttaatattttcctttctttttttttgtaacttcctttccctagtacatcttgtctattaatttccatcaaaagaactgtgagtgctgaccacaaatgtgacactgaaaaggaggactcataagaagagaaaaataccccttgtagattgcttctgaaaatatgtggccttgttctactctctttgatgatttttatctcttcctccaaatctaaaatcaggccaaaatacccaactgtcacaactggatcaagccagctgcaccttttaccaccaagtacaaggctcactgcaacccacggatacccatctaacttcgggacagccatgatccccaataggcagggatgacacccacgaccagcaagaagcagctacagaaaattgatcctcagtgcctctgcctcccataaagatttatggggatcatgtctctcggagaaatgaggcagaatagggaattagggtaatcaagggttaaggcataagtaaaagaacagtagatgcagccagttctaggcaagattaggcagcatttaggccacatccttaatcctgtgataacaagacagtagtctccacttcagcctctgattggctggggaccaagtctccacttcagtctctgattggtcacaggctaatccttcatagggtgtaaccaattggaggcctctaaatggcatctggtagtgttaccaaattcttttaacttaataaaaaccctaggccgggcacggtggctcacacctgtaattccagcactttgggaggccgaggctggtggatcataaggtcaggagttcaagaccagcctggccaagatggtaaaaccccgtctctactaaaaatacaaaaagtagctgggtatggtggcgggcacctgtaatcccagctacttgggaggctgaggcagagaattgcttgaaccaaggaggcagaggtagtgagccgagattgcgccactgcactccagcctgggctacaagagcgaaaatccatctcaaaaaaaaaaaaaacaaaaaaacaaacacacaaaaaaacggctgggtgtggtggctcatgcctgtaatgcactttgggaggccaaggtgggcagatcatctgaggttgggagttcgggaccagcctgaccaacatggagaaaacctgtctctactaaaaaatacaaaattagctgggcgtggtggtgcatgcctgtaatcccagctacttgggaggctgaggcaggagaatcgcttgaacccgggaggaggaggttgtggtgagccgagattgcgccattgcactccagcctgggcaacaagagcgaaactccatctcaaaaaaaaaaaaaaaaaacacaaaccctaaagaacattgtagttgggactcatgagccgcttgctcgagcccgttctactctatggagtgtacttttgcttcaataagtttgtacttctgttgcttcgttcttttgttcctttgtgtgttttgttcaattctttgttcaacacatgaagtacatggacaactcacagtcacaacctttcattcgctaacttattttgcagcttttgccaaacacttgttatatttcagtgctgtgtgctacatgattaatttctgcagtaattagagttttcacttggaaggttaccagtatgttttggatatatgtgtaactcagtcttttttttaaaggcacactgaagagtttctgaatggatttttgaacttttttgaaagaaaggatatttcccaaatataagttatgtgattcatgatatttggattgcctagggataatcagtagtgtgatattacagtgcagctgagtcttttgtttaagaaaataatactttttttatttagacctttattaaaggagagaaccagggaacagtctttatggtagtactgagatttattcagttgttcattcattttatttgtctttatagagcgctgttggtataggacaaaaatctctggcttcatgagtcttagaagataaatgaatataatgttaaataagtgcttaagagcaacccccccccccacaaaaaaaggcaaaatttgaatgataagagagggagattgaaatttttatatagtaagactagggagggcctcactgagaaggtactatttgacagaagagggacccatgttatatccgaggaaagagcattccagacaagggcagaggctggaagtgagtgtgcctggcatgtgtgaggaacaacgaggaggccaatgtagttcagtcaggaaaagattaatgataggagtgcagtgaggtgtgaacttcatgagggacccggtagataataaaggacttaggcatttgttttgagagagatgtgaaatcatttgagggttttgagaagagacacgcgatctcacttctgttttaacagtgccactctggctactgtgttgcaaattgactgcaggaaactagggcagaaataagaaaatcagtttggaggtattggcccagagtgtgggcaatggttttggagtaaggtggttgaattctggatatatttgtgagtggagtcaacaagattcgctgtcaaactgcttgttggcacataagaaaaatggaggaattaaggttggctcccaaaatttggagcctcagcaactgcacatatgtacttttcactaacagaggataggaaggagcaagattgagacatctaagaggaaatgtgaagtagggatgggaattagttttgctgatctggatttcagaagaaatgtctgggcttgagataaaaatgcattcaaaaaaatgcatgtaagtaaaatccaaagccatgtgcctgggtatgctcacctgaggcgtagggaattctgagacctcttatagagaaaggaactgagccctggggtgctccaacatctaggcatcaagagggatcaggagaagtctgtacaagaggaacagccaaaaaggtaggaggaagaccagtatcggtggtagtggaagccaagggaagatggtgtttcaggagggactaatcagctacgttagggtgcggctgagagattaagtcagatgagaaatgactgtaggcattagcaatgtggtggtggtggtggtggtgcaggtctttgaaagtcatgaatcgtgtttcactgcagttgtggtaacagtatgatcatgggatggattcagagagaatgggagacagcaagtataggctacttgctaaggagctctgctccaaaaatcctccccgttcctatatcaaaattttttccttgctgctgcactttaccatcagtatacaaacatgtttcctcttccatttaaaaaaaataaagaaaaaaaagggaaagggtggcagctgaaatgggaagggaagagaagtggtttttctttctttttttatatggaagggacaacatgtttttgtatactgacggtaaagatatagcagtgaggaaaacattttggcacaggagggaggagaatttctggagtaatggtcttaataggtaagaaggtagaatctttgacctgcagtagatgcatattgagttcatctgtagtaaaaccagaggttagttcctggatacagatactgagttgggggaattgtggaaattctcttctgattctgatttctccaaagtaggaagcaaggtggtcggctgagaaggaggctagagaaaggggatagattgcaggtacgaggagagaaaactaatatgaactaatcctctaggagaataggaaagagaatggtgtattatgtatattgaaatcaccataacttgtaaatattgttggagagagtgacatggtagtgaggcagaagttaaaatcattgtgaaatgaggggctgtgaactccggagcagtgaatgcttacagttagtgagttacagtctcatctgacattcagaactgaggttttatgaagggagaatagcggataccgtgttccacctgtaggctcccccagtggtactatttgaggaggttatagggatggtagtgttttgtggaaacactaggttagagcaaagtactatttgaggaggttatagggatggtagtgttttgtggaaacactaggttagagcaaagtgaaaaagagtaaaaaatagaggagatttgttggaacacagtgaaacgattttagatcaggagatggggtcagaaaaaaggattaaatatttattttggagagataaaaatcatataagcaatttagaagtacagtggaagagaggctaatgagttaacctgagtaaaagggaatgagcagacacttgacactgtaaaaaatggctctacagacactgagaagcagctgttctttattgctcctgaagacagaacaaagggaaaaggctattttagttgtatgcgagtgtcataggaaacagacgcaagagaatttttcctttttttgtctctggaacatttcaagaataaggctgttttctttccagagtttacacataatgatataaattggatgacttgtttagattgtgtatttcctgtggtacctttggtaaagattgaaatgaccatgtcagattaatgtcttaacaaacatatgtcatattgcttaagcttgatctcagtggcaaattaaatacagcttaaattgatgagtttttcatcattagttatgaatgcatgggttattctgtagaaatcttaatattgaagatttttagtgtatcttgtattttaacaggttgcagtattttacagagctagcccaaggcacaagatgaaaattattaaggtgagtgtgtaagaatcagattgttttatttctgtatacaaaatgctgctactttacttttgttatgtttgcattacagggagtagagcatcaaggtcagaaatactgtgaagcaaaacagttttttttttttgtaagagcttgacatagaaacactaatagagaatttagttggcataagatgtagaagaaaacttgaatgaagtatctgcaaatacagccttctttaaacagttagacagtataaaacaatgttctaactggggtccatagccgagtcatcccagcgtaaatagcagtaattagttagaaactaaataaatacagcaaggaaatagtgttgtgacagtgtgaacagtgcttaaaaggctatgattatttatattaattagtcaaatgtatttaaaccaactgatagagtatccagtagttaatggtcttaagttatgatagccagccattgtgtagttcagagtttctcaaccttggcaccattgacattttggactggataattccttgttgtgaagggctgccccatatgttattgaatgtttagcagcattcttggccccttcccactaggtgccagtaacatcccccaaatcctgatagtccaaaacatctccacacattgtcagatgtcccttgggagacacaattgcccctggttgagaatcattgtatagttgtttgaagaacagaatttagagatacagttctcacagatgggaatattagtagcaactttttctaagctttatcttactgagatctccatttgttgaagttcattgaacaatgggtggtctatattatttctaatcttaattatgtgaaaaaaatagggaggatttgtttatcgctttgtatggaagcaacatttttatcaaaattccttcctctcccctgtcctctgctccactctagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtaagctttgtttcagtgaatgcctatcagagaatcttcccctatcctttcctgtcccccacccctagagaattcaactggaaaagaattagtatttaaacattaggtaaactaaaccacttttctagggtaattatcctattttatggtatgaagaagatgatttgtgtggctggaacaggcatagtaaatggcaggaccctcatttaagaagtatttgccaagtgccagccacatttcacctttttctgggcactaatatgatggtatagtaatggcctttattttagttaaattcaggtagttagaaatatgcatatgtatggctctttttttggctttataataaatattgaaaattatgaagtttacatccatacctgttttttatatcagtaatttattcatcttgccctcatttaatgttataatttattaaatttaaatagctctatttgtgtcagccacagtttccagttgatttaagactccagtgtaatacatggtggtgtcagtttcacagtgttcaggtggggatcatgtgaatcccatttatttatttatttatttttttggtagctacctgttggatgacctgagtttagtgataaattccaattatatgttccaggctgctttattactctgttttggcctacagggaaacatttgggagcttaggactcacagtatttgccaagcttttgcaaggatatgagttttttctttccattattataattatatagaaatcttagaagaaatggggagttgattaaaaagcatagattttcctggattcagctaaatgaatgagataatttatatgaatccttgtaaaccatgttcttcatttaattcctctgcaacatgtgatctacttgatgtgcaggagcaacacgtagcttaaattctataattcctatatatctcattgccatttgattcctgacatgcattagtttaaacctttactctgcattttgtaccactaagaaaaatgagcttagaggaaggtgaagaagataatcatggctgggcagggtacctcatgcctgtaatgccagcactttgggaggctgaggtggatggatcacttgagcccaggagttcgaaaccagcctaggcaacatgtcaaaacccatctctccaaacaatacaaaaaaaatagctgggagtggtgatgtgagcctgtggtctcagctactctagaggctgagctggaggattgcttgagccaagaaggtcgaggctgcaggtaagtcaaggttgtgccactgcgctccagcctgggaagcagggcaagaccctgtctcaaaaaaaaaaaaaaaagataatcattttatgtattatgaatgtgaagtattttctcttgtgtgaagagacaatgcatgattttaatgttgaagtatcttcttcagaataagaattttaatattgtgacaaattagttcaggtagagcttaggcttgactttaattctttgctaaaataaatgtttccatattgatacatgtgttgtattagttggaattttattttatttatttgtttgtttgtttgagtcagtctcactttgttgccaaggctggagtgcagtggtgtgatcttggctcactgcaacctccgcctcccgggtttaagcgattctcctgcctcagcctcccgagtagctgggattacaggcatgcgccaccacacccggctaatttttgtatttttagtagagacggagtttcgctgcaccatggtggccaggctggtccgaactcgtgaccccaggtgatctgccagtttcggcctcccagtgtgctgggattacaggcatgagccacagtgcccggttggaaatttattttcaaaattagctctacagtgttttagtatagatacatttttgtatgataatattttctcacttcatctttattttttaaatttcaggtctgcaatcgaagagggtaaagggatttataataacattaaaaatttcgttagattccagctgagcacgtaagtttgcaagaaatttgtcaccatgggtcttctggataaattatatgaaaagtagaacttaagcagaatgcctagaaacttctctgccttatatttgtgagcattgttcatatgtcagttttccaaaaagaaaatttattgtattctgaaattttaaatggcatgataaataggttgtaaatgtaacagttagatgtctgtatcatcaaaatgtataaatctttgtgatttatttaatagctcacatctcattgtttcctcttggtatctttttccaaaagtagaaggggtattgtgtagtcaaagaacagttaccaaaatattgttgaaactatcatgcagatgtaaaaattctttatttgttcctgttgtctaaacatcttgaaaatcctttgttaaaatactcttagctttaaaatgtccacgtgactgaagaatagtttacttgaaacagtcttcctttaaaagcatagtagtaagagatttttaaatgctaaaaaagtggtatcatagaatcaacagatttactctactgatatttttaaatgactctctttttcaacaggagtatagcagcattaactttaatctcattggctacattaatgaactttcctaatcctctcaatgccatgcagattttgtggatcaatattattatggatggacccccagctcagaggtacgagttttttaattgcatgagctggaaagacaaggaatgtgtactaccctgataattaagttttaaaacttgatttatggacagtgttggaaaactttgcagcaaatgttttaacatttatgttataaattgtgtgatgtgtgtattttattaattctttttgagtgtgcatgcagtgtagatctgagcctttccactgttagatgcctagcctaaggttgagaatagatcaggaataggtgctatccctgtcctcaggaagtaagtaagccttttatttctaagaaatgggtataatggagaaatttctgggttcagttttattatctaggttctactgtcagttttagagactttgggaaagtattagaggacctgagtgtcataacttttttaaaaaatttaataataatggggtagttgagtgatagatgtcatttggccactccagcaaatcatcccagttaaaacctctttatatgaaagatatttcaaaattcagtcggtaggtcatgtatttcacaccgtatttgaaataggtaaacttacatgtaaatgaattggatggttttttgaaagttgattatctatcccctatcaaattgtgccaaacaaataaagaggagagaaaaagtgacaaaatcagtggttatttttgcgtaatcagccagcgttttatgatgcaacattttgtttctataagaaagcatttagtttgccgaataattgaggttagtgaggttgtgaaagtaacaaatccagaccttaaaacttgaaagtaatttatttttctgtttgtttttaagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgaggtatattcactggccaagctgctatattaacatgaattctgtatatctgataggattcttagttattttgatgggttacccagaaggctgggaagttaagggagctcttttagtgaaaaatataagaacattttaaaagagtttgatttccatctttatggataaataaaattattgattcatgtattagaataaatctgcagagaagtatcagttacaataaaaatacatgaaaatttagagagaagttggaaaatctgagtcttaaaatcatagagccactttattatttttaaataataacagtattttaatatctaatacatagttcatgagaagttttttttttactttttattatgtagattacagctattcactaggtgatttataggaaatttaggtagcttttatgtttcatgtgttaggctaaagttatttcttcctaatggaaagaaaatgtttatattttttaaaaagcagcgatttatccattaaattcagccactgaaaagtaattttgttattgcctcttgacagctacgagacaatgtgattacacctcgagacacaacaatgaccttcacatgctttgtgttttttgacatgttcaatgcactaagttccagatcccaggtatgtttaggtgaacttagttgattgacttgattgactcacttgagtagagtgctttctaataagtaggcaaagattatgggtttttagctttgcttaattttgtagccacagattgcagccccagacacagccttcttataaacatgtgccattggtcacaatgaggatggggcatttgtgggaggtaagctttatgtctgactagaacataaaagtattaataattcacaggtgttgtcatctgcgtttagctggctatagctataagatagatcgtggttaacattatttgagcatagaacaaacctcatagtttctgttgagattttattagtctcattttaaaagacagtattgctaggagtataagagcagttatgtgcctattttttttcccatcactcctgtcactgtgtcaaagcttaggacattctaattttgcttttcttcccttgttgtatcttaaggtgtgactgctgcttcttggtctaagtgttttgatagaaaataatgggctagagctttatggtacttttttagagcatattgtccttaaaaactagtttcatttgaggcatgactattcatttcagctttaaagcactttatgaatccttaactatattaccatttgccatgctggaacttctgagtacagcgaattctcactaattgaccaatttttgaagaagctgtaatatttatttttttatgaaaagtggttttactttttcagtacacacacaattaggtccattctccaagaaaggattttagattatctaccttagtgaatgtatagaaatgatttagcaaaatacaaataaagtttcttgatgtttgggatgttaaaaggtttcttttctttctatggtctaaattatatagtgtcactttttaagcaagccttttcttgataaataaaataaaagctactttaatatttacttttattccatctgaattattccaaaacagtagtaaaatttaagatatttcatagaattgacattgcacaattcagtgataaagtgacactgcttgttaaaaattagaagtgaatataataaagaagttatttctgtgaccaaggagtaataaatgaactctctgctctgccaacagaccaagtctgtgtttgagattggactctgcagtaatagaatgttttgctatgcagttcttggatccatcatgggacaattactagttatttactttcctccgcttcagaaggtttttcagactgagagcctaagcatactgggtaaagaaaacgttatctttatcatttatgtattttagataaatcatattttctaatgtgtttgttttaattttaaaattcttttaaaatagcaaaataagtaactcacttgatttgaaaaaggagtctattttttcacttggggaagctcaggggaattactctcctaactccagggttttggtttttgctcttttataggttatcaattgttataaaaatcataatacgtgattctcaaatatagcaaatcaaaacctgctctagagtatagtttataactttttatgtactatgccatcttgtatgaagagaaaactagacttaatctccctgaaaaccaagttgctctcttctttaaagttagaattttcagtaaactaataatttcattattctttcttgtttgtacattctaatttcacaaaatgtcagtctgaccaaatagcagaatgttttataaagactatttggaaattacacatttttcttacattaccatttattaaatgtataatacagtgcatttaaaaattagttttcctgtgtaggtgtgaggaatgatatatttgacagtaatgctatcctttattgagttctcaatttgggtatttatgaaaaggagttatacagtttcactgtattttttcttgtaagttaaaatttaccttaaaattgaactagttgaatttcagtattttaattccatattcacatttcttcctctttttaaaaaaatggcattttaaggaaacatctgcaattttccaagcagtaaataagaattgagatagtgtggatagtattgtaaagacaagtcttctatgctttgaaatagaacatattaatgtcaaatttttaatcttcagataggcattgtcattcaaattgtctactactgttgatacagtacttttttaaagggctgtgtgatctatgaaataaactccttttgttggtgatactgttaaaggctagccacataaggtttcagggaaagtggtcagaggacttgggttctaattctggctgctgcctttcctagttatgtgactttggataagtcacttaatatctttttttcttttcttatttttaactgagggtgattgtgcctgccttatggaatagttgtgaaacaatgtgtttgaaagctgtggtggccaggcgccatgcctcacgccagtaatcccaatacttcgggaggctgaggcaggcagatcacttgaggtcaggagttcaagaccagcctgtccaaaatggtgaaaccccctctctactaaaaatacgaacattagccaggtatgatggcacatgcctgtaatcccagccacttgggaggctgaggcaggcaaatggcttgaacccaggaggcggaggttgcagtgagctgagatcatgccactgcattccagcctgggtgacagagcaagacttcatctcagaaaaaaaaaaaaaaaaaaaaaaagttgtgttaaaatgctagaaaaatgtaagctattaagctttgcaactgtaagtttcaaagaaatgtaaaacccaacttattttctcttgcagatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaatgacatcccagtggggactattagcattaaaattatccatatggatgctgaagatacagaaattaaaattatccatatggatgctggagaatgcatagtacacagaatctatgatttaaaaagaagttgaatgtacagtacagatccagattgcaattttccataatatattaatccaagttgacatggatgagttaaatgggctagtatctaaattttaaatttttaccctatttcctaatcctaggacttgctagagtccctaacaatactaacttacttgatgtttttccctgttagactaccttatggagttatttggccccataatggctaaacatcagggaagaaaagaaaagaacttaaaataattcactgattaggtaaacagttctgaaatgatcaaaactggccacacagaacaaggctgaacatgttgtgtcacatttgtgctggacattgcatgacccagagatgaaacaaaagtgaaaccatgaaacccgaagaccctcccctctcaggatacaggctttatttatatagcagtaaccaccctcacaagaataagacacattatttacctgccatgcccatgtagggtatgtattttacattggtagtctttttgagatcacttaagttttggtctccttgatatactatataagtaaagtaagtattggtcacacttaaaaatagtttctcactgaaatgaattggaggcaaacaataaacataatatttaggaaacttaattaactctaccttgctttctgcctctgtcacttggcaattcacttccacatatgactcacccatgaagttagatgatgaactggttatcttttcattacatttttttagtacctggagtgtgctagaagtagaacgataatggcatccctgccctgtaggagcccatgaacacagatagcaggggatataactgctaataagctgtttcaagaaagtaaatagggatctttgcccatttactttaaaaatacacatagattaaaatgagtccagtgcacttttcactagatgtttccttgacattggcatttgaaaatctttgaagtgctttttaagactgagctcctgcaatccaaacagcagctgatttgcatactaaaacgtggtatggatgttcatccttaactagtacgtgattggacagacagatcattctgatggttaagtttccttgagctcagttaccacttgaactattaactcttatttaatgacattgttttgggttttggttgtcaagagttggttattgttaataatggataatggttaaccagtccctggtattaatgtagatacaattgtccataaacattgttgtaggtttagatttaaaaagaaaaagtagtatcatgccttcaggaagttttcagtcagttctggagaccaatgtgaaatatatccactagagtggtaaatgctgtccagaatgctacagtagttgaagtagagaaataacttcatgggatcctcaaagaaatttgtcatagaaatttcctagaactaatgacagctgaatcaaattttaagttgggaaactccagctgagaagcagtaggacagtgcagccaaacagcaaagcctctgcagaggtggtggtaggggctataaggaatctgtgaaaaccacaatgagtttgacactgttaaggcaggaggtacagtgtgaagggttggagagataggcaggaacctaatgctgaaagcagagacatttgatttgtctgatagcatgccagggcatttcaagagtttgatgtgagtttggatttttgtatcgtaacatgctgatggaagcacagagggtcaattgtgaagactgaaatagggagaccaattagaaaatcaaggaagcttaaggagtaaagggataattgagctgtggcagtcaggatggagagaaaggcatggaatttgaattgtcttttttttttttttttttttttttgaggcagggtctcactctgtcccccaggttggagtacagtggtgtgatcttggctcactgcaacttctgcctcccaggatcaagcgatcctcccacctcagcctcctgcgtatctgggattacaggtgcacaccaccatgtctggctaatttttttgtattttcggtagaggcagggtttcaccatattacccaggctggtctcgaactcctaagctcaggtgatccaccagccttgggctcccaaatgctgggattaggtgtgaaccactgtgcccagctttgaatttgtatcttctgagagatagcattgacatgactggacaggagaaaaggaaaatggaaaagatactagtctgtggcctttggcttgaatagtagagctattagcagaagaacctaagctaagcagggtttagtgggacacaggtccatctgaaatgtacagcttgtggtgtctttgagatttcccagacggatgtgttaatcaaagctatagctgactaattataagctagtagaaaaacaagcatccattttttttgttgttgttaaattaagcgataagtcaaagtaaactcagctttcacaaaataagattttctttaaaaactttcctttagcatagttattaatcagcaaacagttgtgtaaattcaaaatgcagaaggacaagataatatttcaatctcctttgttgttgaatgttaatagggaatctgttattaaggttactgactggaaaacactgatctgaattactggtagcaatttttttgatacatgtagtaagacactttctaagaggtgagagcgtgtgtgtgtgtgtatatgtgtgtgtctgtttatgtggcataccacatagcttaaggtatgccacgtaaggaaaccccaatgagtaaataacattaccattagaaaacagctacttactctgaatgagtaattatggcagaagagtagaaaacaatgttggtttttcatttgtttgttttttgagaaggagtcttgctctgttgcccaggctggagtgcagtggtgcgatcttggctcactgcaacctttgcttcctgagttcaagtgattctcctgcctcagcctcccgagtagctgggattacaggcctgtgccaccatgcccagctaatttttgcatatttagtagagacagggttttaccatgttggtcaggctggtctcgaattcctgacctcaggtgatccatgcgcctcagcctcccaaagtgctgggattacgggcatgagccaccacggttggcctgtttatttttttaaattttactcgtaatttttttggcctttctagcctcatatcctacacaatgctccaatacagtccacttccagatcattttggacagtgttactttaagttgaaatcgttttttctctgtcccaatgttgagaatcagagcttttacctctacttcagagcccagtgaaatgccaacaagaataacctttccagatttctagtgtgtgtttgtgtgtgtgtgtgtgtgtgtgtgtgtgtgtgtgtagtacagtttcttgtacactttttttttttttggcagggtgttgctctgtagtgtgatcatggctcactgcagcctggacatcctgggctcaagtgatcctcctatctcagcctctcaagtagctgggactgcaggtgcatgccaccatacctagctaattttgtgtatttttttttggtagagattaggttttgccatgttgcccaggctggtctcaaactcctgggctcaagcaatctgcccactttggcctctcaaagtgctgggattataagcgtgagccatcacgcccagcctcatttcttgtaaacactctttgaatgtagcaataagtttgcatataaaattgtgggattttatgttttagaaagcattaaaaatttaagttgaaaacacttgttgataaatctaaacagaaatttggtgatctctttcattcaaaattaaatgtcaaagtttggggagaaaagtgaaaacaattatttgagccattagtttttatccttagaaatccttttctaatgtaaatctgctggtgttctcgtgtacacgtgaacatatatgatgtaacagcctgtgcttgcacagctgctccaggtagatggtgtttcatttgcaggtcaccgtacacacctgattttgctattcctatcctgttttacgcaaatctggccaaactgacaaatatactgacaaaggcccacatttctgtggtggcttcatggctgttaggcctgacagaacttcttttcatatttaacccaagggtgccccagaatcattatttcttaagcaatagttgcattgctctacttaataacccttttgagtagaaaccacatctcattgttatgagcactcaatgccagaaactgagcaaactgttctatataaattccagagatccatttttgggctctggatttgtagcttttgaaaaatgtgccttttaatacagttttttaaaaaattactaatcttctcaactacattaaagaactttctattaaagttttctctgataagtataccaaagtgccctttagttgacaagtgacaatttggtgccatcttagggtcataaataaaataccatataatgcctggaccattgctcttatcaggtctgcatcttgcaggcatactgtgaaacacgtgatatgtgcatcttacaaataggtgactgtagaaaatgtatgtctgataggaaagacatgacaaactttacatttaagcattattagatcaattttaacaagctataaattagtatgttttaattcctattcctgtctcattcatctgtgtggttgcgtaataggattgcattagattttgtaagtatttttctatgtggagtgggtctggatggttggatggtccatgcatcagctagaggtattacaagttagggaaatagtttaatttgatcttgtttaactcacccacatggagctattatttagttttggtgtagaaactatggccaggcatggtgactcacacccttaatcccagcactttgagaggctggggaaggcgggttgcttgaggccaggagttcgagaccagtctggccaacatggcgaaactaaaaatacaaaaatctgtagagcgtggtgatgcatccctgtaatcccagcttcttgggaggctgagaaccagaactgcttgaacctgggaggtggaggctgcagtgagcctagattgcgccactgcactccagcctgggcaacagaacaagactgtctcaaaaaaaaaaaaaaaaaggaaagaaaagaaaaactgtgccatgctggtcaaattctcctgttgcttatttttgtaaataaagttttattagaacacaactatccacattcatttacaatattgtttattggcactgtcatgctgtggcagcaaaggtgagcagttgcagcaaaggtgagcagttgcaagggactatatgacctgtaaagcctaaaatatttactatctagccctttgtagaaagtttgcctactcatttagatattcaaaaagaggaaaataggccctgtaccttgcattcagtggattagaaaggaagtaccatcaattttctctaccctccaatctcccaacagtatattctctcttgaatggatgctcttggtagcagatttgatgtcagtgactactctgagtctccatcaaggcccccatgtagagaaagtcagagtgtctcagactgttgttaaaacatcatcaaccaggaggacatgccatcacattatcaaggcttcttgttcttacagtggctggagtgttctgatctgccgtcccatctgaattgtgcttcccatctctctctctttgctcacccaattttttatccatctgaagcagtctgctcctatctggttgatgggctcacttctacctcttggatgcacaagagaagtggaggtttccctcctattggttgtacaaacccagagaaataaagcttaatctgaataggcttaagtatgttatcttgcttagagaagacaacatttagtaatagcagaaactaaactatcctaacagctcagtcttagggaaaaaatatactcactaactcattttttcagaacagaacattctaaaccaaaacatatttgcatagttcccacagataccaaaaggtgactgtatatgtgcatgtatacataaatataaaaatatatttatattttgagagaaagacttagctattttaaccaaatagaatgttttcaggagtagcaggaatagaagagattgcatgtgcattgtagcatgttcatttttcatttgatttctgtccctaaaaacagaatccagtgaaactagctggaaatacttctttcatgtattatctcattcatttacttctctcattttaacagactgttatatggcctggtgcagtcacgccttttaaattttaaaacttccttccttaacatgaagttctcgtcttagaatttttacagctggatggacttgaatttggtattactcacacctctggaaagaaatgcagaagcagcttatcctgtatggctcagaaagctgttgctgaaagtggggtgtaatgtttttaatacatttttccaagagtagtatttaatttcaaattggtacaagatgcagaatcactttcagctgtgatgactgaaatgtgtcattaagacattacgagataaacaccaagtaccccacatctgtcttattgaaaatacagtgtcatattttgagtcaggcaccactgaaagtttatccttttatggaacttcctggtcttggtagtgacagctttccaggtgctgctcaggtaaatggtacaccagccagccaaacagcatgtggtagagagcagcacccagtgaaatctggcaaacttgctagggggaaaactgggtttggcctccttaggattatggagtagggccaggttataaccctggtagttgcaggaagaggaaattcctaggaaatggtaatatctgctcttcatctttttctatctttttttttttttttttttttgagatagagtcttgctctgttgcccaggctggagtgcagtggaacgatctcggctcactgcaagctctgcatcccgggttcacaccattctccggcctcagcctcccaagtagctgggactacaggtgcccgccaccacacccggctgatattgtttttgtatttttagtagagacggggtttcaccatgttagccaggatggtctcgatctcctgacctcgtgatctgcccacctcagcctcccaaagtgctgggattacaggtgtgagccaccacgcccggccacctttttctatctttaaacatgccaagggctctttcaaattgggctttaaaaacactacagaaaactctctgaacataggaaaaagggctcaagggggacaggtactcacatggggataattccttctggtcttttttcattattttctaagtttgagcttggctgcccattgaaattgtcttggtagttttctaccctttccagtgtggctacggctggagttgctataatattctcacattcctgcccatctttcttcttcaccatatttgatagtgttgatctcctttgcctctgcaaaattctgctcttaaacctgtggcaactctggtctcacgttgtcttaatctttgtactgcttaacactcactcacttcttcccacattccttgctttgccctggcttttcatgtgcggatataacaatggctatcacttataacacacttttagtatcaggcactgtgctaagtaacttaaatatacttgttattgtatcttttacacaataatttggactgttataatccttattttgcaagtagggcaactgaggcatagtcattgatttatttccttttgtgcacaaaggagaaaaagataattctaagggctttttagctatggtctttatcttctgaaattcaaattcagatgtcaaaaggttaatttgaattctttccccatgatcaaatggcatgaaagacctgtgattatatttacaggatgcatattaaactttcaaggtccaggtgtctcaaaaagtgcttttaaaaaatagacttccagtataattttatcaccactaaatacagaacatgattaggttatagtaaaagttttcctgtctctgcagctttctctctaaaatttattcatcttagctgcccagagttccttttgttacttgaactgctaattgaagacagtttccaaagcctaagatgagatttcatttgttagaactgaattagaaagagcaggacctaatcacttgattgcaaacataggaaactagattttggaaagggaatatgggatgtacaatattctgcttctacacaggtgttcctaatgtatatctgatctcaattttaaaattcctattctttaaagccaggtcaaaagccaggtctgagaatcttcttgtgatttaacctcttctcatcctggtgaccgctgtttccttattgtagtattcagtctgcactttgccattttgcacttgacagactgctttatgtaagggtaaaaaccacagttacttttgcaccaacttaataaaataatctcttgtcatttcattgtgtgttgtctcccaagcagcctgaacaagaatgtcttctgcagggggttcaggtgctatgtcatcatttttcggtgaaccaccttacatactcctgtgaagtgcctgtgacctctcatctaatacatgtaggagaagatatacaccagagtagtatacttaaagggacattattagactgtcactgctttactgcaaggctggataatttcagtggaatggtcctgagtgccatggttagagaaaggaacctgacttattacttctgctggaggaggacacttttaatgaaagaaaaacatggtagatgtaattcagtggttttaagaagcagtgttgatgataacccaggaaatgggacagttatattaatatagtctccagattagcttcaaactccaggaatcaaggtagggaggatttgatataacaacggtcttacatggtttttcttttttctttttttttttttttttgagacagtcttgctctgtcacccaggctggagtacagtggcgccatctcggttcactgcagcctctgtctcccgggttcaagcagttctcccgcctcagcctcctgagtagctgggactacaggtgccctccatgatgcccggctaatttttgtatttttagtagagacggggtttcaccatgtcggccaggctggtcttgaactcctgacctcaaatgatctgcctgccttggccttccaaagtgctgggattacaggtgtgagccactacatccagcaccggtctcacatgtttatagtcctcattagataccttattttccagtaacatttcttctcaaaaatagatgtacttgactactcttttcttgattcttctgggagtaaccatctctttggagatggttgttagtaaggttataaaaataaccttactgaggaactcccatgcaatcctctgaaaataataaaaatttccttatttcaagaactcttatttaacaaagtaattgttagggttgaatactctaggggcaaatgatttattgtgccttttgtaaaagtcaacacttggcaggtgtgtgtttgacactggctgatgctgggcttatttctctaagagtatggtaattctagtaaagtaaagaaaattgtttatcagatattaggaactgtacataggcctgctcaaaatggcagctttaaagctacctttagggctattcctgatggaatataccagtgggagagtacagaaggaagaacacaatttgtatgaatacaagtaaaatgaaggttgagtatattttcagatcttgcccaatgcatttattctacttggttctctttattttcaagttctcatttggaactggccggcactttcagaactctgggtatttctaattttagcagcctctatttggcagtattttccagagcagtaccttttaaacttcttccctacagtccacagtaaggaatatattttacacaatcacctaatacatgatatgtatatctgatattttccattctaactttttcattaaaaaatgctgggtatgactcattaaatactttcacatctcattaatgggtcaaaatctgtagtataaagagggcatagggtctggtattgctgcatatatctcttgatattttcacttctcactgtttcctccttctccaggtctaacagctcaggatgctgtttcttatttggctgaagccattagtttcaacttctcctttaaaacctggagtgcacctaaagtgctcttcaatcctgtcatggtctcattgactaagtacttacttttagtagagacagttttctgtctggcatcctcacttctaactttcattggccagacttcatactaaagtacaaagaggaaactgtttttaaaactttttgaaatgataaccagctgctacttaaaggcaataattgagtgagacttctactttctgagaatgtagctggctaaattgctgcaatttaaagcatatagactatattaccattaacttgctgaaatggaacatgagaagtataaacatggtttcaaacatatttagaaatacagaagcttcttaaatcaggttgtatttattaaaaacaaaatacaaaataacttggaattcagattattgtgatgtttatcccctaacaggtcagtcctaaagaaaaagctaattgtttcaagggtggtaacggaagaattttaagtaaggattatattaaatacatctagtttgatgcaaactgagttttattcaatgttggaggcctcactatgttcctctaagttttcaaccattaacaacccaaaccggttgtttccctcataccaacacttggtgtgtgcagtggttctccctctgttcttagaacagctggtattctgtttcttctgcctttttttttttgaatttgatctaccttttggtaggaatatttcagcgggggcatatgaccttgtggcattgaatagatattcataaagttgcttagcctcaggacatatgctcaggagactttctacagaggtcgatgctagcagttgctggcatagtccgtgcaccaggcttccactgtacagtctgttcaaagcaagaaaaaagtatgttgttaaagaagtaattcagtgcaacaggataactaccattgacatagcttcaacaaatgcatctaaacaatgagagctcttattgctctataatattatcgaaattacttaagaataatctgttctttgaaggaaggaactgagctggtatgacaaagattctttgctggtgatacttaaaaacttttcatcaacaaattacgtgatgcatgcttagtggttttgcagctagccccagactgagcaggtgtctttaacaaacactttaattttaaagaaaaggaatttaaaaggaccctgataaaccaaacaggcagtttgttagaatatgagaaaatttattggcatcatttgcaaggtcattcactgagactaaaaacctacttcacaaatagaagatgggattaattggaatccacaagtttattatggacaaagctgataaactggtaccttagcaatccatgtagaaccatcatttaatcagtgtaacatctctgtgtaaaaagccttggttatgctaagattcaagaacaatcctgctgtttaaatcattattaagagaactgttttgttttgcatttcctgttttgttttaaaaggatttgtggtaactaaagaggatccagtcaagaatggccttaaattattaaacgaaagaaataaagaatccaggggtcaaaggccaattagtcttatttgtgttagctcagatataaggcccagagatatattaacaacactgtttactgccaggaggctttttaccttgaaacatgtaaagtcccaccatattttgtatgcgtccatatatcctcattcaaagtattgaaggcactggggctgcaacagcaaataaaatagacaagcccctccccccacagagtttacatctgagtggagagacaaacaaaacacaatctatctcctttttatcttcatctctccctcaagtacctcctggatggtcaattaccaagatgtccaatccattgatcctatcacttttttcactgctccacaccctactgctgctgtcacttctttttatcatacccagcttaaactccacagacaaacattataattactctgtggcacataggctcaactcccttattgtccttcttgcctggtaaagcaaacatcctaggttaagttcacttgggcatctactcatcatctcacttagaatgaaagctccattagagctgagattctgtttttgtccctacaccctagcacagggtaggcatttaatatctgaatgaatgagtaagccatatgccaagtggtaagaaatgcaattaaaaaaaaatagagtaacaggactagagtgaatgagggtagacagtgtgtctcactagggtgggttatcagaaaaaggctctacaaagtgacatttaaagactgagaggaaaggagagagttgtatcctaccaatgattgcctcccctctcccacatattaatgtattacttaaaggaactgattttttaaaattggattgaatcatggaaacattctttgagaatatggaaataatttaatatttttcccgtttccagctcttcagctgtaacagtgactcaaaatcaattacattaagattagtttttttttgttttggtttttttttttaagtaactttgttgctttaaatataagtgaaaatactgtatttacttttgtgtgcttccatctgaactaaagtttcccatggtgcttaccgagttaggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccgaaa

SEQ ID NO: 15 - DNA, 135125 bp, Homo sapiens
cactagggggcgcgtctctgagggcagggcctccgtctccgacgctgacttcctcagcgcagccagcactgtctccggtggcaagtcgaccagctcctcccacacggattctgtgtagaaatccacggtatgtgcattggaaatggacagggcatccctcaggaactgcagcagtccctgcaacttggcacgcagcgtgggcaggtccggggtcaccgggagagggcaagaagccgccatgacgctcaccctccgaggctgtaggtggcgcaaacatggccgtgaggcgccagctcggcccaaattagcacaggcaggctcagtagagctccgagccggattccttctgagcgattgattgcttcggcttggtgacgtattttgtgggcgtccgtcgtggtcttctgatgacgcagttagtcggctgcaatggcgccggtgaggcggtccgcgaagtggcggcctggtggtattgaggcgcgtggtgaaggggtttccactgtcgggtacaggaataagaatgtgagacagaagacatggcggcctaaccacccgcaagccttcgtggggagcgttcgcgagggtatgtaagaaggcaaccatttgcaaatcctcaggcttgctaagttttaggatataagattcgctgaagcttggaagaaggatttaggaaccagacccggtcctacttggggcaagggaattcattcctgagcccgctaaagctgtgagcttcgcagagctctagataggaagacggagcagtgttgctattatttaaacgtcttttctgacgtaaccctgtatttcatcagaacttttttcctatatttttcctgagaaactgagcagagagagtctatgaccctgtgaactcttgcgcatgtggtaaggtaaaggatagagaggaggacagggccagaaacactgctccgaattcttccttattacaaatacccgaggccctccagccttcgctttaatttgtgtttgtcattttgtattgctgtctgtaaggtctcttagatcccacttggaatatataaatgttaaattcagtcttccgataattgctagcttttcagacaaccatacactgtctttttctttcgtgttgaaacattttcgaaaacatgtagtttgtccaagatactagatgtggcattttctttcctattttttaagcatttattgaaggctcagattaagtgttttagatgaactaaggaatttgttttgatttgtgaatacagctgtaaactcaagttgtgcaacagtctgaactggtcagtttttctttgagattcttacttggatttccgcatgactgttagcctggtctttttgcaaagggccaacttactatgcaatccatcagcttaaatttgttgcttgaaataattttttaaagcaaaatataatactagaatctgaatgtgatgacgtaaaaaaagttttcatttgtaattaacagctccattcttcgttcaacttcttttctctgaaagtaattttggatgatattcctcaatgtaggacaaggctttgcttttcgaagaaaactgaaaatacagcaaagttacaagaaattgctacggaaggaaaagaaggctcaaacgtcactggaatctcaattcacagatcgatacccagataatctgaaacatctctatttagctgaagaggaaagacataggaagcaagcaagaaaagtcgaccatcctttgtcagaacaagttcaccagccgttgcttgaagaacagtgtagcattgacgagcctttatttgaagatcagtgtagctttgaccagcctcagccagaagaacaatgtattaaaacagtaaagtatgtattttcttcatttgaaatcctttaagtgttgttttattatttaaaagtactataggataatttatataggaattgtattttttcttatttaacacattttagaagtcacggtttaattagggaaacattttcatggaggctctatttttagcttcaataactgaattaggctggtttagcctaattgacaaagtaacgtaatgggaattaagagctctggaatttgggtttcttcctctcaagtacaggtggtaacttgattggaccatatgttatgactatatttttgaaaaataacttctgagaggtgttataattttagtcattaacagtatgggttctagagccagactcaacatgttagtgccccagtgacctcttctttaaaatgggaaaaataacactatgtcctctttaaattgggaaagataatactgtaatgaatatatacttcagagctgccatgttgcacagctccagaatggattactcacataaactcaggtgttcctaaggtgtttcatgacattgttgtgaagactcagcgagttaatgtatatgaggatcttaaagggtatatatggtacgtggttagtgctcttgagcgttagctactactattaatctggattttctgcagaggaccagaaatgggttgcaattgcaaatgcacagctccgtgacgctttggttttataagagttaacttataaaaaactatcgctgcatacttaaagttaaaaaacaatgctaaaatctaaaattgcaagaagctgggtattaacttgggagcataattttttacttcattaaaaccgtatcttttaaagtcgtgagctatttgcgctaaaaataacaggaaatgggaccacggggggtaaaaatgtaattggggatgaaggcagagacacaaaaagtttactacttttggtaggcttgatcattatattgttaaataatcagtataaagttcagggaaaagattagcagtagaaatgtagatttgagttattctctgataattgaagtaaggaagtttaaatcatgagaaaggaaggtaaaaaatcatgcttttaaagattacggtttattttggggtggaaacagggaaaatattgtcattgaggaagttaagcttttcaggactggagaaagagaaatacagtgacagctcagtccacagagaaaagttgtgagggattagtcagctatcaaatattgtggtcccccgttatctgtttggaagatgttccaagacccccagtggatgccctgaaactgcaaatggtaccaaacccagtttctgtcaattggaatgtatttctgttaatgtcttttacttgggaatttaatgccttttccatcttaaatcacgtactgtggccataacttttgcagtttgaagtatgacagcaaaactagcatgaatttatttttccttcacaatttgatgtatagaagattttttttaaaaccatagatcttagcaacttcaacatacgattttttttccttccttattaagtcaagaacttttaccttttcacttaaagcaaacactcagtgtggtgtacaatttaaaacatatgaattgtttatttctggaatttttcaatttaatatttttggacctctgttgactgcaggtaactgaaaccgtggaacagggaaaccatggataaggggtgtgctactgtactataaagttgaaggtgaataggactgaggacaggtctctggatttgtggactaggcagtcactagtcactagtccaaagtcgctagtgattagtagctattaaaatattatattgtagttacagagtatagtgaaaagttgaatgatagaggaaagtaaagttattactgaatcaaggatgctgaggaaatgaatggaattccaagtagttggattagccttgacaaaaaggacatcttcagagaggtgagaagtagttaaagatagaacagttcaaaatggtatctagatccaaggtatggtgattcatgactaggtaggtaaaatggaatagagaggaggggctcagaaaacttcgagattaaagttcatatatacacataattttcttaacatccttaaacaacaagtttaattcttttttcagtctggcatttctatcattcatatactggtttcattacttttaaaagtttttttttttaacattttaggatttttcatagctttctatattttttcctagttgaaatatttctctaagaatccccatttgtgccttttatttaatatatactcttaaaagctacaactgtgtttttaatacctttttggacattttactaataaagtcctgtttcctcatcccccaattaaaagctcctttacaattccaaagaaaaataaaaagaaaacatcaaatcaaaaagcacaagaagaatatgaacagatacaagccaaacgtgctgctaagaaacaagtaagttctactttgaaaatatttagtatagtttttcttatttatcctaaatatatatactatacctgttgtgcttcttggtgctgggcacacagtattctctctgtaaatatttgttgaatgaatgagtagtctgagcaaaggtagaggattgcatcttattccaagtccttgcttgtattatgtcaagcaatactagtaggtcaaaaataggattttgaacacattgtttataggtcaatattgtgaacatctgggacaaagtttcactgagtttggtccaggaacttgcacttgttaacaagcacctcaaaagatttttatgtatgataaaacttgagaaccactgacctaagaaaaatatagatgattttcataacattacattgaagaaagtaaaagcaaaggggaggtgttagaataaaatacttttttactataaagaggtgttcttgcctgtttaaaaaaaaaaaacaactattattttagcttagcaaaagttagcactctattatttagaaaaccagaattgtagaccagaattaggcttttttcaaatgaatacagaattacccacagcctcaacaaaattgtcattttgttgtaactgtggtagttcttgtttttccattgaagttttattgatctgtagctttaaaaagtataatgtgtcagttaaaaataccctaaagatatgtaattttgcttgtttttgctttagaatatctgtaattaagaattcttaacatcaaaaatgttttcattgttcttaagctggtggcagattaggagaaagcaggaaaatttcttcatgggaatactggaccagtattaactagcacagctttatgctttttccaaccatctgtcacctttggaaacagtatatcagatgaagtgcagtaatgaccattatgctgtaaaacatttaatgtccttttaaaattttgtttatatagagctggggctttgtgatcatgaaaattctctgttataccatgggtcattataatatgaaggcaaagagggtactttgcttcaattaggagaaacagtgcacatcttgcaaaatagaagagacaaaccttagagtgtttgcttagtaatagctatttcaagacaatttctgaactgtatctactgtttgttgctaatgaaagttacatatgttaataattttaggaattcgagaggagaaaacaggagagagaagaagcccaaaggcagtacaaaaagaagaaaatggaagtgtttaaaatactgaacaaaaagactaaaaagggccaaccaaacttgaatgtacaaatggagtaccttcttcaaaaaatacaagaaaaatgttaaacattttgttcctacaggttaaaatatctgctgcctattaggttcttctgtgacatgtgcctcccagcagtgaactaaatttgtcgacataaactggattgctaaactatgctaaatataagatgttcacatatttttattatggtaaaaaattttctaaatatgttctacatgtttcttatttatttgcctctgaaggaaggttggcctgaagaactgaaagaacctcttattttgcaagacaggcccaagcatgtaatacttttgtaccatatgagatttatatgaaataaattttttaaaaataaggaatcagagctatcaatgaagcatttcaatgaaatatttcaatttagtaaacagttacgttgttttaaaatttattttaatgatgagggaggcaaagactcctcttggactttttatttattttaagtacatgttacagggtgatgggtgctgaaataaactgccctcaccatataacaaagcgaccttcacaaagcagtgaactcaaagtctgatatttataaacattcccttaaatggatgtacatggcttgttagtctaaggtcttttaaataatgatggaaaccccacagtgtcacagcaagaattaagctttccagttcctatggaccctatactttaagaacattatctctgtctcccttgttggtacccttgtgagctgagataagccactgggataactgcttctcatgctttgcaaattgcagaagaatgagaaaggcttgaaatatatatatagtcattgtaagcaaaaagggctgaccaataatacttgccaaatattgaataataaaattttataaatgatagcaaatacagtctgaaattgcattaagattttagggagctctttcagtctactaatttattctgcatttcaagatcagtagaaagtgcttagataacactgaacttaatcttcattgcatagaaaagcaatgctttagaaatttgcattgcactatattgcatttaaagtaagcagcccagaaagcctaaatttggctacattggtgaagacacatcacatcatgatggaggataaattatttcagtaaattgctttacaatttttgtgcattttcacttctagacacttaatcatgacaaaacatggaaggagatctagtccttttgagagacaagtgaaagtcaaattatattcattttaacgactttgttaaaagctactttatgcaaaacttatattaaggagttactctttaaaattccaaagttcttgtagaggaataaatgccaagtaatggtataatgggggaaaaagtaatcagtgacaatcagataaagcaaaaggttaagattttagtgttatcaatgaagcacccaggaagcttttcctttttcgttttttttttttttattatcttggtggtggacagtctcccgcccacgctgcagtgcagtggtgtgatcatggctcacagcagcctcaaactcctgggctcaagttatcctgctcagcctcacgagtagctgggactacatgtacgtgccaacacctggctaacattttctgtagagatgaggtcttgccaagttcagccttgcctgggctggttttgaactggcctcagggatccttatggctcaaccttggccgtacaaagtgctgagattataggtgtgagccactgtgcctggcctataggcttcttaagaggcatgtttgaggaccctacactaaggaatttggatactgtagatgggcttagtaatggatgttttaacaggcaaccccagtgattctgctgggttgctcctcgccacacttaaaaaatgttggaccagggcctcagagaagaaagaggttttgtttggtttaagaaatcagagaaagtttcatgtgtgcaatagcatttaaggaaagccttcgaggttaaaaagattagaagtgtaagagcatgaggaaagttacaaagggaagcaagcttggtattatttaaatatctaataagtagttagaatatattattattgatggaggtaatagttcctatcggttccctattgtttccttccatgtggagaagacaccatcatccaaacactcatggtatctttacttcttgtcccacttgttccacccaggggaggtaaagtaataaatgatgtctgggaggaggacctgggctgtcagcagagtgcatgtactcttaattgctattctaatactataagtgaagaacaggctatattgataaatgttagaagggggatggatatttttggaaaatatatatagaaatttgtgctatatgggttagtacatcaagaaataaaagaggaataaaatttgaaggagcacaacatagaaagagagaggcttaattgtggccatagcttatggtttctggtttcagaccttaatgtatacgtagggagctttgatcttggtagtttgtagaggcttctattagggctattaatttgactttgtaagtgtgaagtaggcttttagttgcagttttggcaagaggctttaagacttaaggcacgtgggattttgacctaaaagtttaggatatctttgtccagagaaattggtaatttctatagagacaatgtgcaatactgggctttaagcacatatgcgcaggcctcaatgaagcagagtttgagtgagggtgatggagacatattggcttcagcaaagacagagaatctggaagtggggctcacccaaatgctggcctcatggatgtcctcaccagatgccagcccaaggtgaggcttagcaagctactgtagtggtgctggcatcaacaaaggcactggcatgtgcaagtggtctcatgcaggctactgcagcttgaccttggcctacattaaatatgcatgtgtgagcagcaaaggcctcactcatcagatgctgctaactcgacaccagaaaacaattttattcgtggcaaggatttaatgatataagaagaaatattcatagctatgctagatgttaatgactgtatcagtatttgctacttttaaagacatgtgccttggttgcaatataaagttctagaaaagctcaaggtctaaattgttctgagagtcattgaaatgctgtgtaaaagagaaaattttgaatctgaagatatttgaacatactgggaaaagatcaggtctcctttgacttggtgattgggactggaccactccaaattctatacttggtaagatagcatcagtgtttcagatgtcactttctgaaagagaagatagagtaccatgctaaatgcatggtgaaaagtttaacttgttgctgacaaatttcttccaacttagtttaagtgtgcagctcatgtgactggcattctgataaggctaaagccatcaccggttatcttccttcctactgattcatgagttcctgctatagagtttctgctacatgtagtctttggcaataaatactactgagttttgggagcataattttgtacaggataactgccttttaaatttggtgggtataaggcaagtattgtaattaccttgggtgttttattgactctccagaccttttgtaagttgaggcacaccatagagttattgaactaatttaacttctgaagtgccaaatgaatgtgttgtatccatatccaaaaagagacagccaggctgcagctgctgaaggaatcctgagaggcattaagaacatttctgcctgtgagtgaatccaataagaaactgggaagggctttaattttattgaacttttaccttattacagtgagagaatttgattctgggttttgattattttggtctttggacattaacttgaaaggtaacttaatatgtagacttaattttctccccaggagtttgataagaggaaagatttatactgaaaggtgggacatctgcattttgctggcaaattaacattgggtgctttttatgtatttggataattcccattgagaacacttgattgaatcacccatggagctgatagagagccctgtggtggaaatgctacttatgggcctgatgaccttgggttttacaaaaagatttattgaggtataattgactgagcatacataaaatgttcaatttggtgactcttgacacttgcatatgctcatgaaaccatcacggcaatcaactacctatcaccatcacttcctaacgtttcctcatggcctgttgtagtcaatcccaggcagccactaatctgctctgtcactagtatgcattttcaaaatttttatataatcaggatcatatactataaacttttttgtctgggcctctttaagtcagcataattatttggagattcatccatgttgttggatttatcaaaagtttgctcctttgtattgctgagtgttctattgtatggacatagacaatttgtttatccattcacctgctgataggcatgataggcattcttttttttttttttgagactcagtctcactctgttgctcaggctggagtgcaccagtgcattctcagctcactgcaacctccactgcctgggttcatatgattctccttcctcagcctctcaagtagctgagattacagacgcatgctaccacacctgactaatttttgtatttttagtggagacagggttttgtgacgttgaccaggctggtcacgaactcctgacctcaagtgattagccctccttggcctcccaaagtgctggaattacaggtgtgacccaccactcctggcctggctcttaaaaataaagctattatgaacatttgtatataagtcttctacgggcatacactttaatttctgttaggtaactacctaggagtagaatgactgagacacatggtagttagtatttaacatttttgggaaatatgacacctgtaaaatgactgggtactggaaaaggagcttcctggtaaaacggataaggagcctatgaagtcaaattagtggtccaacaatgacactcctctaaggacctcagtaacaccccattgtctgctctgtgttttatctatttgcagggtcggccttccagttcctagaggatatgcatgctgtattttctaccttaaatttcaccactttatctcagtctgttcttcagagaacaaataaaataactggggaggatgtctccagcaaacactgataggctatgattttaccagacttgtaacttttcccagtttcagttgtgtgaaactaactacaactaacttattgctccaactaaattattgccactcactctgtaatggtgttatggaattaaagtacaccagaaggcagcacattggaacaacccaaattacagcagatcctttgcatctgttggactctcctggtgcactgttagatcagactacttctagtcttcaggctaaagattctactgatgagagaaatatttgcaattgaccaagtaaggttcaaataaatccttataaccccccaccaacgtcattccaatatctacacaaacctgaagaaatcacaggaataaaatctattattgagtctttataagaataaggacagccatatctcatccttgcaatcttcccatatagccgtttaagaagcctatcaagaaaggatacccatttattcaagaactcagggtaagcaataaaattatgatttctagattcctggtagtttccaataggaacctgtcttgtcatccaattgctgaagaagtaaatatttatttcatagtggtagatgtatgtgcagcattctttagtacacatgtagatacagttaacatttgttcactgtttttgtgggaaaattaacagcatatgtggctatataccatagttgctccaccccccacccaaccctctgcatccctggttttgcttttcaaagtttcagttacgtgtggccaactgcaatccaaaaatattaaatggaaaattccagattcctaagttttaaattgtatgttgttgtgagtaacatgatgaaatctcacaccatctcattctgtcctccctgaaatgtgaatcatatccagcgtatcccagcagtgtatgctatctgtcttaggcacttagtagccatctgggttttagatcaaaaaataataataatatgtatatagagtttggttctatccatggttttatgcatcctctaggggtcttgaaacatatgtcccactgataagaggggtctactataccacatattggatttatggactcctcatcaatttgttttcaatctaaacaaaatgacttttctttgagggtccattctcacacaatatgtagatgatattttgcagtgccctcttgatctaagtatttcacagagactccatatttcttttcaagattagctgaaaaggggcataaggaatctagagaaaagtgattttgccaagaaactgaacaaattatttgagtcatgatctgtcagtacatgggtatttttcgtacaccaaaacaaagaaaattccattttactaaagctctaaattaaaagacaatgaaaaaatttttaggattgactggttattgcaagcaataaatacctatttttttaaaagttgctcagtcttcttatgaacttactatgacaacaattcctgagactttctcgtgtgatataaaagtagaagaagctttctcatcttcgaattcttctctttaacaacatcccactttgggtatccctaaatcatctaaaaaccttctctctcttgttcaagaaagacaagatgatgcattgggaatattaactcaagagaagcctgtttattgtctctcttagcatatcccttggtttggtaactaagatctaacccaattttcatgtttgcaggaggtggcagcagctgccaaactggtgaaagcttctgccaatgtggcatttacttttcattaactctgtggtttgcatgtactgggcaatcactgttacttctaggcaacactcgacatttatctatcaacaacttttacatttatgaagcccttttattctttgtgcatcactatttaccattgtacaaattgtactcttataactggaattcttcaagatgaagggaaaacatgactatagcaataactcaggaattaagcatacccaggtcagaccttacaaacacctttttagttaattctgatttaatatagtttatagatgggtttttactttaaaaaatgacaatggcatcctcttctttctgtatccactgaaaatgcagccattaaagcagctcattacattgtattctatcttcccaggtagctgaattaatagctctgactaaagcttgtattgtggcaaaagacaaaaagagaacagatgtgcttttaagaattgttcatgattttggaatgttatgaaaactggaaggatttatgacctcttaagatattttgactaccagtggaaaaatattaatgttttagtgaaagtgattaaaaactcacaaggagatcctagttattaagatagaagtgcatacgcagatcaaaatctgagggcagtggtcttgcaaggttacatctaaatgagctgcttttcacatcgcagctaaaagggatgctttaaaatggacatctctctccaccaaactttcaaaagaagtattgtctcaatttaaactggctatggttgacttacagtgattagctcaaccttctgaaaggcaaagttggggatcccctttccataaagatagattttggcaattttgggatttagtgccccatagcaccacaatcccaccaatgaacccaggtcagattattctatgattgttcacgttatagaattaaaaaaactacttttgcattaaataagtaatggtagataacaagcataatccaggtacatctgttaaggtgaggcatggttcagttcctctactcaagactcttgaggttttgcagataggctttatacaactgcctaaatctttaggctatgtatacacattagttattgttggtaaaagtttctggctggatagatgcttttccttgccaaagagctaacactgtcacagttgttaaaatattaaaccatacattcccaaacggaaatactcatttcatgagaataagcataaagaaactctgttagatctttccactaacccagaaaattcactgttagcattaccccagtcttaaagagaagtagaatgagtaaaggagacactgaagatgacactgtccaaattttcataaacatttaattttcccaggtctacattttcccactatcattaataaccatgtagtcctctcctcagagctcccatgggctttctataagatcattacaagacaccttccaccactaggaaaaactttactgatgcatgcagacctacctggatggtgtcagaaactaacctcctttactcagtcttatgcacagcagggatgagctacctcttcaaaggaaacaactcaacattttgcatgacctccaacccaagaagtgtgtcatttagaagacatattgtattagtttcctagggctacaataacaaagtactacaaggtcagtgtcttaaaacacaaaaatgtattgtcttactgttctggaggccagaagtccgaaacccaaaatcaaggtgtaaggagggccatgctccctttgaagatgcgtcacagggaaagattggttccaggattctcttctggctctggtaattcctttggcttatggcatcataactccagtcttcacatgttattcttcctgtgtgtatgtctctgtgcccagattttcttttttattaggacaccagtcattgaattagggtctaccctaattactgcattttaatttgatttcatatgtaaagattatatctccaaatgaagtaacattctgaggtcctggaggatataactccaatgtatttttttgaggatacacaatgcataacacatcaatgtaaaaatgctttacaacattgctgggacaccgtttttgtttcttctgtgtcactgtggaaacaactgccaacccaaatcagtaggtttctttcacatgagatattaaactgaggctacatcaaaagccttcagaagcagacaactttaagagacagtcatcctgcccaataaccctgaaccaaggagatgacagtggtatcatcttctgtccctgagacaacaaaataaaacacagcagaatgaattccttaggaaacctttcccttttaataattattattctggcattctttggtgatttagcctaaatatcatgagatcattctttttttctcagcacttaaccacattcagttcttagtactgtatattcagaatacatagtgacagcctgtgcatttgtattgcaaaaatgactgtgtatatgaaaactttctttttcatacacagaatatctccatactaccagtcccttgtaattccagttattccacatctgtgatggctctagtccccagtggtcataatccacttgaggtttgtgaaacctttcttgtgattctctgaagaggcccaatttacctgattgaaaattacacaagtcatgtggtctgaatggggacaaactttgttataactcagtttcaggggctaaaaacaatagttctcatcacaaatatgtcagtttcagcaatatttgagaaacgaaaaatatcaaagtaataaagggaaataagacaaaaagtctttagtgcaagtcttaaagattgatttgtaagtaactccttcctccctattccaattgggtttgtggaactgcagcttactagctattacctgctaactgattaggcttagtcatttagccttccttatgtcagtcttgcagattgacaggatctattagagatggcaaagaaatattttgtccatcaaaaatagttcatcactggccaggtgggttcattagttcaaggaaaatttcgacttgttttgtttatagcaatacaatgtcgctgtatacctttcagaaaattattatctcaatgaaacaactccatggctgaacttctgatatatggtgatatttaaatgatgatatatcctagagttgactaaattctttatggtcaaatcttctcctctgggatagaggaaaaactacaggaaggaactgatgaagtttgacgccttggacacatcacctacaaagcagagtcagccaaatgctataatcccaaattagggaactcacacagcagaggagcttaggtagtataaaataccccacacaaacaatccagccagctcagtatttacttaatccacaaactcagatatagccatccccagaacatcactgagaaactttactttcctaatacagaacagagatggttcaggatcttggggatatagaggatctactctatctctccttctctaagtttcttttgtgggagcctccaatattatatacatatgcatacatatatatgtgtgtataggtatatatatacacacatgcatacatacacatatatacatatatgtatatatacatacacacatatatacatatatatgtatatatacatacatatacacatatatacatatatacacacacatatacataatatatatgttttatgtatcatgtataaaattttacaacaggaatagaaaaacaagtagaggaaccttgcttgggttaaaaagtattgagtttgttagatttacacctgagtaggcctcaaattatctgttcacagcagtggagaaagtcaagtgcatctttaataccattcattccctcttgccatccttaagaaaacatcttttggaaattctacttgagtcactgtggctatacattttgaaggttaatttttatgcttttaaatgtagattaaaaagtgaatttattttaaaagcattggcatttttgtgtgactagcattttatgcttgcatgttgaaaatggtattttggatttcttttgtcttcatctatgtacaagttggcactcatgtatcatcttaagttataaacattcacaatgactgttttccctagttaaacatgataaactactggtaaattcattcattacattcttactcccaaactgcatttctaggcaaatttatgtttggtatgctttattaatagagtaagaagaaaatcaaagttttgaataagagaaaagaggcttacaatttacaataacccattgctagccacttaaaaatttttgagatgtattctgcaatatgaataattatgatctataattatggatattcatatattccttaaagagtatatgctctatcatcaattctgaagtcttatctgcattcttcaattttatagggatatttttacattagtagcctaaaaagtggaccactcagatgagtcatgcctacaacctttttgtatacatagaaattttaccagtaagacgtatgtactgttctaggaaattagaaaccactaatctaatatgaaaaatgagaatttttctttgctgttggttgaaatagtttatcagtatgcagtattctgctgttccaataattactgaaattgagaaacattattaatgatttatgtagagtatgataggaacaaatatgtttgaattattaacttacatatttacagtttggctaaggatggaatctatgtttagagttgtgattacaaaattattactcagttgtcacttttaaaaaaacctattaaagactttttgagaactagcttaaacgttttatcttggaatacactgaagaaatgacaaatctgagtttggcttctgacacagtgaaactgggacatagagcttcaagattagacactgaagtaataataaatactactctaaggccttcctaaaagtggctcaattaactaaactcatatatatttctttcatttagaattcatggtaacagaattctaaatgtaatttagaatttatagtaacagaattctaaatgtaatttagaatttatacatggagagagatgaagtaaaatacttcttagttatttattcaaggtcacataataatctggtttctgagctagaaacagaaactcagtttcctaactcccatcccaagctgctatatagatatctctagaaattccatctgtgaaatttcaatcaagacagatgtcgttaagcccgttgaaggttttgcttgttctgtaattccagatttcagactgattattatatagcaattcacagtggggtttttgaacagtagaaactggcacagcacttggcaccctgtcggcgcaaccatgacacacatacacattcaaattaattaatgtcccagcttcaaccgacttatccgggctgaccaatgtgatctcaagacaaatgacttttttttttttttaagctagcaatattgggagcagtaagctgttcttttttttttaacttttaggttcaggggtacacgtgtaagtttgttatatagctagtgagtcacgggggtctggtatatagattattttgtcacctagttagtaagtatagtaccctataggtagtttttccttcttaaaatgacattcatctacaggtgtgcatctagcattccatttctgagattctgtagtaaaggaaaaaggaaggcagatggaagaaacatttaaaaccatattaaatgtttacacggaaataaatcacatttcaactgcttactggcagtgcaattttgcaaaatcatttaccttttctgtgccccagtttacccatctgtaaaatgagcatgatataggttcataatattttttcccaaaactctggagtctgggggtatttcagaattctggatatttaggattttaaaaaatagttcagtggataccatacatttacataacagtcacagcagagtctcaggcatattaaaattgctgcagcaaaataaataaatattcaaactaagagacataattcaagaatataaatagcttcatatcaatccaagtcagatttctacctgtgtgagaataaatgaaacaaagttttcagaagtttttggctttcaaaataataggtaagaaattgtagacctaaaataatatgtacatcataagaacttaagtggttgaatacagtatttcatgcaatgcacttagaacagcaactggcacatagtaaatgcccatatatgttagctattattgtttattatattaactctgatatgttatacatcaattttatattgtttgcaatgaagtacagtcagttagaaaaagttttccaccaaatgtgtcatggatggatttggcaggtttgctgataagatttgtgttggattaaaggccaaaaataataactgctttagaaaaaagcctatatgtgtcaacataaaacacctgtaattacctgtaattgcaattatttctctgtaatattatagatcttaattacattatatttcatataaataatcttttctttatgccccagagaggcagtagtaataatctttaatatcatttttatattgctaaattgaaaatcatgcagagttgtcattgtcacaggatataaacttgttcaatcaatggcaattaaaacccttaaaggagaatacaaaaattctcaaatgacacttaagagtgttgaataccttacaaataatatctcccaatattttaattacttacccttgtctccctgttcctgaaaactttttaaacacttaatgttactcaaaaaataatattttggctgggcatggtggctcatgcctataatcccagcactttgggagctggaggtgggaggatcacttgttcaaagcccaggagtttggagaccagcctgggcaacaaaagtgagatcccacctctacaatcaatcaatcaatcaataagcaagccaggtttggtagtatgtgcctatggtcccacctacatgtgagatgggaggcaggagaatcacttgagcccaggagttcaaggctgcagtgagatatgttagtgccagtgcactccagcaagggtgacagagcaagaccaagtctcaaaataataataattattattattttaagtatatgatacaaattaaactttatattcctctctgtttaattgcagatactttttaaagtagactaatgcaggcaccacaaaaagggtaatgatatttttcactgaaaaagcccattttcagaagtagatttctaaacatattttcatattaatataagctaagagtttggacattctggactttggaagtactttgccgaatgttaagcatattatttttcctctcataacacaattgccaaatatttcaacatgaaagataggcattttgaggccaattaatagcaaattagtaatttgggatcatgaaagaaataatgttagaggaatatgtagatattgagacactattaatctggtactatacatatttaggaagtaaaattactatttttattgttattcatataagtacctgtcactgtgtaagagatttgtgaatagcatttcatttaatctcacaatgaaccctatgattccacttaatcctatgattggttgaataataacatgaaaattataaaatagtaatattaaaattgtccaatactgcatgtctcatttaatcctcttaacaattatccgatagatactattattgctgtcatttttcagttgagaaaattatgcttcaccatatttaataaattaacttatgtgcaatccaggatccacacacttcatacatagaatagtatgcatccaaattaaattactcaatatttgttttttgtgtacagaattttccaacttagtaccctactcgattcgagcatttggtttccaaataggaatgatattcattatctattaataaaagtttctttcaagccagtgattcatttcacaattgcaaaaatgaaaaaaagatattcaaaacttaccaaactggtgtatgtttccaaagaaactgtaactaaaatacagctatatttatcttgttttctagtatcaaaggtatatgcaaaatgattcagttacctgataaccaagaaatttttatacagtattaattctgctaatgaataaactgaatagcagtatatttttaggatgcatatgtatataaatattatatttagaaaaatataaatgttagtgtcacagaaatggagttttttaaaagaaaaatgatttagaattatgaatgattaatgcattggtatacatcttcccaatagtatagtgtttcttactctttctttctttctgtctttctttctttctctttctctttcttttctttctttctttctttttttttttttcttttttttttttttggaggaggaggagtctcacttttgttacccaggctggagtgcaatggcacgatctcagctcactgcaacctctgccccctgggttcaacctattgtcctgcctcagccctcagcctcccgagtagttgggattacaggtgcccgccaccacacccggctattattattattattatgtttttgtatttttagttgagacagagtttcaccatgttggcaaggctggtcttaaactcctgacctcaggtgatccgcctgcgtcggcctcccaaagtgctgggattacaggcgtaagccaccatggccggccgttattcttactatgttaaaaacatgtttttacatcttcaactattctaaatcagcattctagtgattcatagttgaataatatttattataattttgtgccataatcttttaattccaaattttgacttttcaattatgactatcctaaaataaaaagacaatgtaatgaactttgtgtatataaatctttaaacatttttctaatgagttttcctttaaaattttctgttttatactaaatatttctaaataaatttatatcacatgtgtatttgggaagctttagcatattaactatcatcataaatatatatcaagtgtatgttgcaaagtattccattttgagattttttaaaaactcccctggatagcccaaataatcggttttactgaaaaggaaatgcagaaaaacagtattgcatggttctgaaagacagtgagagaaaaatgattattttccaattccttatttatatttatttaaatataaaagtgcctaattaagttatcaaaaagttccaacaatttccatgacttctaaaagaaagcatattttattttcctaattaacttgaagcaaaatagctgccacatttcttttcaataatatctgatatattgtagtatgctcttagaaacttttagttctctagagggtttcgttttattcagatctttcaggaaggaaatatgctttcagaaaatgattttattttttcatttaaagagattagcattagatattaacattttgagttatgttcctatcctttaaaaaacaaaacaaaacaaaacatggaaacccgtattgaggaatccaagaatgtgggtttgataaacagaggttatgggagattggggccctggactatgtatttgttaattctgcttttccccacctcctgtgcacataaagagccattaacattgcaatgattaatttcagaatagcagaaaactctagctattactctgacatttataaaggaatcctttccttggaacacatgagggacatttgttctttctttctattagatacatgctctttgaaccaaagctagacagttattaaagcctgtctggcctgaagaattctttatggggcttagaaaagaaaggcaaattgatctttccacctagcatttattcttattttacaaatgtcttcttctgtactgctttataaaaacagaagattccatggtctatttttttctagcaattgaagggtgtttaacatggtgaagttgtttcaagtgttcagagagttgtctgttctatcctatagtgaaaatcattcttcagaaataagtatgtcttacgtttttggattaaattgggccagagagatgttgttgagtgaagaaaaacaggataaataaatataggagtgggacatcatgcacgtagatattacttagtttttctcatagagatctcatagaaagttacttctttatcatattttatctttaaaaatgaattataatgaaatgataccttgtagatctttttagatgaccaaaaatgacgaagatccatgaatttaagttacacttaatttgcaagtaatgcagccacccacactttatattaataaatattactacaacacagattatgtaggtaatacaaaataagcagagagaactacagatatgctttgtcttgaaacttattgtcaataagtagtgcagtagctgggtgcagtagctcatgcttgtcattccagcactttgggaggccaagataggagaatcacttgaggcgaggagtgcgagaccagcctgggcaacatagcaagactgtgtctctacaaaaaaaaaaaaaaaaatcaatcaaattagccaaggatggtggtgcacccctgtagtcctagctactcaggaggctgaggtgagtggatgacttgaacacaggagtttgaggctgcagcaagctaggatcacaccactgcattccagcttggttgacagagtataaccctgtctcttaaaaaaaaaaaaaattggtgcagtagttcaggtagggagacctttgtatgtgttgacgctatctatctcatgtaaggcagtttaatatttattcagtgatactaatcaaaataaagaattcagtaagtctatacattgtctaaattgtgttaaacttaataattcccaggttgtaacataaattaggctttaatataatgcgttttggtttctaaaatgagatgagaacatataatttgcactctctgtagtcacagcatgagactgcttaaactctgcagctggatgtttatagttacttctttcctaattctctttgcagtgctataactgaatgtgctacatattaaaatccatgtcttttgtgctgatgtattaatgctttttctaaagctgagcatttaactgcaaaaacaaaaatattatggacatataaagggctctgctacccctatttttttctgttgctgtaatttaaagaaaaatgaacttcttattatgacatagaacctacgcaacttagttccttattacacaacttcttctgaggctccagtgtatacattatacaatgaatgttatactaaaattcttatcactcagtaagcatcgaaccatgatgccacactgcatggggtcactgtgtttagaagatatgttaggtgtatatttaagaggtgaaatggatgggacttggtatttaattaactgaagtgggatgcagtaggcaagggagaatcttggattaccccccaattaatttttttgtgagaaacactaaaataaagtcataggcagagtctgtgtgtgtatggggaagtggggagtaagaacctggaaatgttactgtaatcaggttttggcacaatccttgtgatttccctatacctcgtctgtacctgtgtaaatggtttatttatgaacctcttctctagttgatttgtgtcatctgctttctgccaggaacctgattggtacaataattgtaatcagaagcagccccaggaaacagaacttcaaatttaggaaatgaattgcttaaatatttgaggagtattgggaagaaatgagatatggataattcattatgtgtagtgacattactattactcaaatgattacagcttttgtcatgggatgaaatatatgagcaggccgagggattgggatattaaatgattatgaaacttagctgcaatggctaacagagtaattataaactttttggtgtcacccggcttcttctgataacaccagagagtgtagatgtagaaattgtgctattgaaaatttaaaatatctggcatggatgatcagaaagcctaaagagcagatttgaatgagcctctcatttcctacggccatagagaagatatagaagagaactaagtccaaggtttgattgtgacaattgcggagttttaattctaataaattctcaacatctctaggtctcttatgctgatagaaaagtatcagtggaaaaggggtgaagttttaaaccacaagacagagacgtttgagcagcatagataaggctgagaattttcatgttcttcccagtcccaccatcaatttcgtcaaatagaagatagtaaaaaaagaaaaaaaaccacaaaaacaaaaacaaatctcttctgtataaaaaatctttgaatgcatacacttgcctcagaaactcattcttctcatggtgcacctataatttcttccagacctagaatggatgaaaagtagtgtaagaatttcagcacttcaccaatctgtattgacaagagaatgtgtgtgggaatggattttaagggattataccaaggaagataaaatgtaaggtgcaattgtgttgaactcattgtcatggatgcattcacccataatatggaatttaatattttgactaacgcatgtaaaaatacattaataacctgataagttgactaattgaagtgtggactcaccaataacctatgttttaaaaagtggaaatgcctgaattttgctggcattctctaaaggatgaagtccaaacacccccaaaaatagaaatgttggaatgaatctgcccagcccctttttactttaccttaaagtggggcagttgaggatacttccttctcaaggcactaagaaatgtgttattgaggaaggtgtgagcctggtaagcatggaattttgcaaactggctgctaaacacagctatcattaaaaattagactaattaactgaaaagactattgtaaaaataattattatttccccaactacatatctgtgtgaaacaggaatgtcttcaaatacttcaaccaaaacaacatattgcgacagattgaatgcaagtgcatatatggtggcctgcacctgtagtccagctattcaggagactgaggcaggaggactgcttaagcctaggagtttgaggatgtagcacaccatgatcatgcctgtggatagctgttatactccagcatggtccttgacaacattttaagactctttctcttaaatatatatatatatatatgattacatatatatgtatatatgtaatttacatgtatatatatgattatcataaaatagcagatgaacacctgtcaaaatttattcagctcattaatgagataactatcaggaagactaagctggttcaaataaacaggaattatattctcactggaaaaataatactgagtgagcatgccagtgagacacaaaacttgttaatatcctataaagcaataaaaccataatttcttggattatattttctactgaaaggaaataccagacaaagttacacaagttaacatgtaaaattacatagtttgagtctttaatcaatattagataattctttaaacatagcaatagaattattgatttccctagataaaggactatttcttgagttgatcaatgtttgaatttgacattaaaaggatatgctgctctccctttgccttatttccaaattttggataatttttcttaagtgtccccttataatgatcataagtaatttataaaggttgttccaaatcacaaagctggctagtttcataatattttaacctgattatttacatacgtaccttgagaagtattaattaatataagcctcatagggcatatagggttgaacaaattgctattagaaaattaactatggtctgaatatttcagaaggaaaacagagttagacttttaaatttctcttttttgcggttttattttgagtctagaaaacaaaaaacaaaagtctttttatacaagatttattgcagtgcctataaatttgagtgaattttctctttgcaatcactcaaatattcttagattcctggctaggaagtgactttccttatcacttgcaagactgggactttgttaagtcatatcacaggtgacagtccagtttggtgtgaggatgctctgggtatttgctccatatgtgaatttaaatacttatctttttaatgatgagctctagagagttatgatcaagtgtaattctataatatgacctgagtggtactgtcaatttgtcccggtaaaaggaaggatggattcttattgaacctatgaaataaatgtgttgccatgaataaaaaggctcagtacagtcatctgtttctgaatttggagaggtctctgagaatcagatatcatttttaaaaagtttcatttcaaattgcaaaactataatctactgaattaagggttagagataaattaatcataaaaggaaagatttcctttaaaatgcttcataaaatagatttataaaaataataccaatagcatgccaaaagaaataaccacaattaaatatgctttactaatgtatttgattctatgtaagtaatttctgttcttctggatctgttttcttgaaccttgcatctggactaaaatgattcctggaaatcataatccagtcctctggtggagtctaaatgttgtctgagcaatgttcacattaactcccaaacctgaaaccatgagttacagttacaggttattttaggaaagattacctggtacagtcctttcaacaaatctctgagactgactcaatcttttgcatgtagtgcataacagaaccttcaagaaaacatgaaataaaagaagaaattagcagttgttgataagaccgaatgacagtagttaatttactagaacaaccaaaaatatcagaatggaagaggacatggaatggtcagacaataaaaccagattcccattaattgataccacaaatgaaaaataacttactgaccctgtgcaaaccagatttatgtacacatgttccctgtcttaatgtccaaactctgtgacttctcattttgttcagcccttttgaacataatttatactttaactccaacctgccatcttgaactggcctaacataacagtgtgcaaaggacctagaatatgcaaaacaattttgaaaaagaagaaaaaaattgaaaatttagctatttgatttcaaaatttgtcacaaagttacactgatcaagacaatgtgcaagtagcataaaagtagatataaagatgaataaaacaccattgagtccagaataaacccatgtacagtcaatcaatttttttcattgttaacaaggtaattcaggaggaaaagcattatcctttcaatgcatggtggttaatcaatgttcatatgaaatattcaattctgcaatattcatatacagaaataaaagaactttggcctgtataaaacttaaaatgattcatagttctaaatataaaagctaaaaatatatttctagatgaatctttgtgattttgacttaggaaaaggttacttagattaaactatgatatgtaggctgggcgcagtggctcatgcctgtaatcccagcactttgggaggcccaggtgagcagatcacgaggtcaagaaatcgagaccatcctggccaacatggtgaaacccccatctctactaagaatacaaaaattagctgggtgtggtggcacgcgcctgtagtcccagctactcgggaggctgaggcaggagaatcgcttgaacccgggaggtggaggttgcagtgaacagagatcacgccactgcactccagcctggcaaaaaagcgagactccgtcaaaaaaaaaaaaatatgatgcataaagtaaaacattgataactatgacttcgtcaacataaaaaaacttctgttctttgaaaggcatcattaagaaaatggaaacacaagccacagactgggagaaagtatttgcacattacctatctgacaaaggacttgcttccaaaatatatacatcttaaaactcaataacaagaaaacaaacaatccattgtaaaatggggccaacgatctgaagatacacatcaccaaagaaaatatatagatggcaacaagcacaggaaaatatgccttgtatcattcgttatcagggaaatgtgaattaaaaccatatctcttagaatggccgagatgatatgaagggtggctgtggttatggagaaactggaactttctgtcaaaaactgcaaagggtctgagattttacccaacttgcaagctaacaaattagcctccacattttatgaatactggtagaagagacaagattcttgactcaaagacagagaacagtttactatttacaacaatagcagtagccagagtattatcattttttttcaccagtcccctgaaacctgatccccacagggttcttcaataaaggccagctggatgctataaatgcagtaggtttttatcacagcaggggaactctgagcttagaaaatctgtatcttttgtgatttgcccaacctttgacccagagggaggcattgtctttattatattagacagtaaacaaacctactctcagctctctcagcgctgttcactatacaaatagtccttaaaaaaaaaggtagtctgaaataaaaaagcagttaattcctttgctcccaaaatgggcagaaacttgaaaaaatagattccaattaccaccttagcaccaggcttgagacccttaccctgttaatgtttcccaacactcactgtgcttttgaatcacctgaagagcttcaaaaaaaaaaagaaaacgaaaaacaaaaaacaaacaaaaaacagcacaggagaaccaatgcctatctccaagattttgattcaatcaacttgagcacaatattttttctttgtttattctctaatttattttaaggtgcagccaaggttgaggaaaaaaaatattgcactacttttctggcataattttgaaactatattgggaatcagtattgctgtcacaggtgatcacagccagcccctaatgaaacctgtggaaaacaagtggggagaacgttttatcatttacctaatatgtaaagccgttgctctgagcacagggtgggctttgaagaggtggttttcaacatccattggggagttttctgaagtatgagtgctggaaaattcccctgctgcctctctcctctccgcacctgaatttcatggacatgactgctggaaggttagcatttcttttaccttttgggggtaataaacgaaaaataaagaggaattatgatagagcctatgacctaaaatgtacagaacaaaccttatgtcctgaaagatatataggaatacctcattttagctgtctatctttgaattttaatttttattaagatgtccaattataaaaaatattaatacctattttaattagtaaaaaagttcaaaaatgtatataaaaaaattaaaatttccccccaccctctccattcctacctcattgatagctgctataaagggcctagtcctttccttccacaacttcttttatgctgacccaaacatgaaaaatcatatacaaatgccatattgttgtgactgctttttaaaattatttatcatggttcatcttaatgattcatcattagcaatacatatttctttctgacaaatatgtatatattatatattttatttaaataattatataataaaatgtactaaaatgtattcaagtattttatatttgattactattagaatgtttcctattttttgccattacaaacaaattacattacgtgtcaccagatgcatgtcctttggtgttggtactttgttttcattggcgatattcaccaagtgaaattacttcagcaaatgttgtgtgcctgtgtgtgtgtgtgtgtctttgatttattgatattgccgaaatattttttaaatgattgcagcaacttgcactggatgttgttatattttgaatttttgccaattagcccaaggcttaagtatcccgttaatgacttgtaatcctcactgtgcattttacttttattctccttgactattagtgaggacaagcaggattttgtatgtttattgactctttagatttcttttgtgaatttccttagcataagtctttgcttatttttctattgagttccttttctatttctcaccaatttatagaagctttttgtgtagtagggaatttatgcctttatctatcatatctgttgcaatatttgccccaatcatttgcctttgatgttgtttatggtgttttccttttatgaaaatatgtgtgtagataaatatgactatttttcccttatcactgctaagcttcctgttttttagaaagaactttcccatctaaagataggaaattcttcaaaatattgttgcaatgattatattaatttaatgtttatatttaaatttttaaaattccgtctggagtttattttggtttagagtatgaagtcaatatatatctttgttttattttcgaaatatgaccaagtatttaagtatacattgattgataaactcctaattcccaacttgattcaattgtcatgcttgtaacaattccttaaattcctaacacactcttttggatgctctactctttacactgatctttttctttcttttttaatttttcctgtgcctgcttctgtttttttttttttttcaattttaattttggtgagtatataggtgtatgtagtaatggggtatatgagatattttgatacagacatatgatgtgtatcatcccagcactttggagtgttgaggtggagggattgcttgaggctgggagttccaggcctcagactattttgattattgtgattttatattatagtaatagcctttcagtatcactttttatgatataagctgtattttttagggttaaaagaggataagtatattttaacttgaatttttattatagttgaagtcattatgcaacatataaagtgtttctgtttttcgatgctagattattatacaaatatgtgaatgactttttaaagttaaactacccttataaggccagcagagggagttcaaggcactgttttactagtgaggaattacaaattgtttaagaatatattcttttactgattaatggaataaagttaagaattcaaaatattcactcaaatatcttgattggtcaaagtttacacatacataatcaaaaagtgcctatatatttatagccctccaaaagtcaaatcatttaggaatgaatctaaatttccttttgaaggagggaaatttttggcatatatttagtttatgtacacagtgcagataacataaaattgaaatgagtatagtaaatgtgatttctacttaccttttatgaccaaagtcagaaaaaaatcagaagactgtaaaatagttaataaatatatataaatatatattcttttgtcttatttgatcacatgagcatagttttcaaatgtaagaatatacatagaaacagaagaaaaccttgaatgaataatacctctaaatatttttaagtgcttttccccttcaagtgtaggaaattagaaaaggatgaaaacatgatcagctaaaaggggattgactatttagcaggaactttataaatgaactaatcttggatatgttattccaatggaagttttgtttgcagcctgctgctctttgctatttataaatactagaatgatggagactgctaggaagcagaaaatgcttcactgaacttctcggtgacagtaattcaatcaagcaaaggttacaaaagccctgtgggctgcttgttatgtgatagcagaggtagacctgattttgttgtatcagatattatttaagtcaggaagcttagtgttaaatttaatgctctatcaaagtaagtctattattctgagtttgatatatccatttcatttttgttctagattttgttctgtttgttttctatatatattatctgctgtgtgtgtgtgtatgtgtgtatatatacaggcatacctcactttattgcccttcgctttattgtgcttctactgtgggtagaatgctatcaaacagcattgcatgctacaggctacagagaaatcttttctgaagagaaaaattggttgatgaggcaaacttcattgttattgtcttattttgagaaattgccacagccatcccaaccgttagcaaccaccaccttaattagccagcagccatcaacatcgaggcaagactctccactgacaaaaagattacgacttcctgaaggctcagatgatcactagcatttttttagcaataaagtatatttaaattaaggtatatacattgggtttttttagacataatgcttttgcacagttaatagactacagtatagtgtaaacataatttttatatgcactgggaaaccaaaagattcatgtgactcactttattaccatatatactttattgtggtgatctggcactgaacccacagtatctctgaaataagcctatatagatttatttatataatattgtgatgtgtaatttattttatgaaacacaatatattataaataaaattgaatatttaaaggtataataatgtgttgataaaggttttaaaatttattttaaaactaaaatttctcaactatatgctatacatagtacagcaataattaaattttgaaaaaatattcagaatgatatatttaaactcttatcattattgaattttccatgctttcattttaaatattttacataaaatgagcatttaagttttgaattttgctaggaaacacaaatataacaacttttaaattcctagtcatacttcgcaaaaagttgtagtattcttgtaaaatacactcattttaaaacaggcttagaaaacaattgtaaataatatatttgattatccatcttttcttggagataagaaataacagagtattaccctaaaatgcattataaagcaaaaagttatacatattttagtatataaacttaaaaatatttctatatttttaagtaaaaataagcagttaaaagacaagcttcaaactgggaaaagacatttatacaatatattaaagacacagatcacagaataaacttttctgattcacaggataaagtttcccaattcaatattttttaaaaagcaagcatttccaagtataggtatttcttaaaagaaaaaaataaaaatgatttctagatacattctcaccagaataagcaaatttgcataatgaagtttttcatctatgttttttgcctttcaatttggctaataaaaacaatgataatgtacagtattgaaatttggggaagcagtaactcaggtgcattttcagggtgtctaatttgatgcaattttccagacaatttcttgacatttatcaagagattaaaaaatatccacacactttgacctgataattacatttctgataatttatcctaaagatataatctttgtcattttacattgactctccctttttcctggaagctcttcctcagatagctacatggctaactccccactgtcttctcatctatctttactcatatgtcacctattcgataaggtcttccctaactagcctgtttaaaatgcagatcgaatccttccaactcatactcccttattctgcttttttttctttactccatagcacagtacatcttccaacatacttataatttgtgtacttatcgtgtgtattggttatcatgtcttccctcagttgaatttaggctcaacagggactgaaacccttgccttgctccaagatgtctcatttccccaattttctggaagagtatccagcatgtagtaggtgtttataataaatatttgttgaatgagtgaatgtcaaggatattaattttaacatcattaatgatagcaaaatttttttaaaaagaaaaaatttatcttaaaaattcctctgggaatggttaagtaaatcatgatctatccatgtgtattattttcctagggctgtcataacaaattaccacaatctgggtggtttatgacaacaaaaaatgtattgtgtcacagttctgtgggccagtgtctagaatcgaagtgttgattccttctggaatctctgaagaagaatgagttccatgccccctaacttctagtggccactggaatctttggtgtatcactgcaatctatgcctcaatcttcataacaccttctctctgtctgttgccacttctatactctcctaaggtcacgtaccattggatttaaggcccaccctaatccaggattatcttattttaagatccttaacttaatcacatttgcaaagattctttttcccaaataaggtcacagattcatgtagacatattttggagggccaccattcaacccactataatatgttacattgttacagcactatttaaaaatcttagtttggttactgtttaaaatctttaaaaatgttcataatgtaatgtttaatttaaaaagtaggctgagcccagtggctcatgcttgtaacagagagattttgtctctgcaaaagataaaaaattagctgggtgtggtggtgtgtgcctgtagtactagctactgagaaggctgaggtgggagggtaacttgaacccagaagtttgaggctgcagtgaactgtgattgcgccaatacactccagcctgggctacagagcaagaccccgtctctaagaaagaaaaagaataaaaggaggatacaaaactttatttctatgtgcatatgtgtgtatgtttttgtgtgtgtgtgtgtatatatatgtgtgtatatatatgtgtgtgtgtgtatatatatatgtatatatatatatatatacacacacacatatatattttcacacagagaaaataatccaaattttgactttttttttcttttttttttgagatagagtcttgctctgtcacccaggctgcattgtagtggcatgatcttggcccaatgcaacctctgccttttgagttcgagcaattcccatgcctcagtttcccaagtagctgagattacaggtgtgcaccaacaccaccagctaattttagtatttttagtagagatggggtttcaccatgttggccaggctggttttgaactcctgacctcagttgattcccccaccttggcctcccaaagtgctgggattccaggcatgagccacagcgcctggccaaatttttgaattaataatgtgaaggaggtgccgggcacggtggctcatgcctgtaatcccagcactttgggatgccgaggtggctggatcacctgaggtcaggagtttgaggccaacctgaccaacatgacaaaaccccgtatctaagaaaaatacaaaaattagcggggcgtatggcagcgggcgcctgtaatcccagctacttgggaggctgagacatgagaatagcttgaacccgggaggcagaggttgcagtgaaccgagatcgcgccattgcgctccagcctggatgacagagagagactctgtctcaaaaaaaaaaaacaacaacaaaaataataataaaataataatgtgaaggaggaaatataccaaagaaattaaagaaagtctaatgctgggatgctggttggtaggaatataggtggttaatttttctattcataatttctagcattttccaaaatttctattacaagctgatttaaatttttatatttacaattctcttactatgaaaaaactaaattaaaatagacctcataaaatgatttattggaaaactagaaaaaattaagtttcaaaatggcacagcaattaaccatttcttttatatctaacaccatcagttttaccgtcatgaaatttttatgtcaatctgttcaggaggctacgaagtcatttgtccctaggggttttcaggaaaatatgagagaaccattcagttgggaagtttagaaattcacctttcagagaacaagtgaagctaacacactcttggactcccttgtagccttatgatttagtcagttttagcatagtatatacattttatgatttaccaaaagcatattaattagattaaaagttctcatcttgtctttgaacttgtcttctttggcctgctttttacatttgaccttattatgctcaatttcttcaattgctctgttttcctaattgattaattaatgtcataagtgtcaccattctgtgttctctctctctctctttctcttccttttcctcttgttttccttgccttacccagtgagcttgaatttgtatttgggagcattatcagtcatgaatggggagcaggtgcttacacaggaggcttgcatttgggctgtctgaagaactagtctcccctatctacctgcttaatagcacatacgaggttacttccgcaaagcacaataggcaccacacaggagtctggtctgtgccaagactggatggaagccgtggagggaattgtgaatataaatgtcacagagattcctgtggttttgttctcatttatttgaaccttgattgacccaattattatgtgcaaaaacaaaacaaaacaaaacaaaactgtagaggtagagtctccaagataattgggtatatacactggatgatcctgggaggaaggtaaagatagggaaggaaaataaataattagttctgttttaatattttaatgattaaattatttaatgcaatgtgcaatgttcttttctagtgatacatatgtgggagatctcccaaatgtatatatagtgtacaataaagtcaaatatacttaatctgttcatatttattaataaacatgaattaattaaagcagggaagaacttgatttgcaaacattacctatattatcggaggcataaatgagagcagtttcctaaatttgctaattgttctgtcctgctgtggacattagccagtattaggccttttagccccaacatgaacacttccattttgaatctcgttcaaaagatgatacctccaggaattcagcaaccctttactttgaaaatctatccggtgtacctctagggaaatctactggattgtctctcaattagccagctaagtctaattctctcaaagccgtttagcaccacatcaatgatcggagaagctacattttatcagattgcatttaaactggtgaggagagtcacctcccctattttgcacatgatactgagtacattctggtgatgaccactcctcaggcttcaaatgtgagcatgtcagttacacacgaggaaagtaaccaagtccctgccaatggtctttctcgatcttaatctttggttcttctatttaccttagataacatttgtaaaagggaaggggtggttacatttgaagctaagtgacctaagtattttgtacccaacctctgatggcttctggagatgagggtcatcaaaccagaagaaagactgacagtaagactcagactttcttctagtgtcgcctgtcttccgagaattagattttttttccttggttatttttagaagcagcatgattgctgctgcccagggattaagaaccgcaaaccatgttctctatgaaacattttcaagtcaggactgtgccatattcatttttataatatttgtgatgtgccagcatcatcaaattccaataaacttttcttcaatgcacctaggttcaagtctctgctgggacacataaacatgagccagccatttaagttccctgaggctcattttctccatctataaaatgaatgttttaagatgctgctattgtccattttgaggaaaaaacaggctaatgttaataaatatatttgtaatctatggcattgtatgggaaaataattaccattttcacatgctaaaagtgtttatagataaataaatgctgtattgttgaagctctaagataaggttaaaaaaagttgttggaatacccaatttgaatcttgacaaggaacattggtatacaatttttttgtcataatatcctagttaatttttatccatagcactttaatcacatatttacttgtttgttttaaatattttctcgcttgttaataacatttactgaggaagagaccttggtctaccatgttcccagctgaatcctgagcagttaaaaataacgtctggcacccagtagacactcaactatttttgaaatagatcaatactacttcattgcagagaaccactcaccactggatctcagtctgctaatgtttctgtctgcttagtatttttgaaacttcttgagactggagaataggaatgatttttaagatcacaatttttgtatcttatgtaaattgaaaagaaaaatattaaaaagcgtatgtttggagaaatatgttttgctgctgaaaattacaggattatgcaggggacaaattattaaaccacagtcgtatggcaggcaatatatgttttactttagatcattaaacttaaccttttgtgattaatatcatactcttatgtgacattttctaggaaacagatttcagcacttgttttatgtttaaaagcattactggctttcctactaacaaaaaaacatttttgagtggaatcttataatccatagcaaaatcttgtctttaatcagcatatacaaatattgtttcatgtttattcaagcatgcactaaagtgactggcatatttttggcagttctggtcaaagtttttccccttttcagaaatgttaaaccaaactgacagtttggattatctgacagccttcatccacaattgtctaattttttcacaatgtgagccaaattattttcttgtatatagagtacaaaaaagattgaaatgttatttcctatgattgttgctttccaatttgagaatttatggagacgttatagctacatgcaaagacatagatagttgatatgaaatattcctgaaagaatcatgttaaggattttagaaactttcttttatattccacttgctctggtggaggtaatttaaattttattctgaatttgaacattttagttttgcttctttcacttgaacactttttaaagatgtctgtctttcatttctctctgaatatcattatacattttgataatttgttcttctctgactgataatgaaatttattttagcattttaagttctagatgagagttgctgggtcaactggcacttcctcagttcttaaaacaattcccttacttttttttctgttttggcaaaaaaaaaccccttaattaacaacttattttaattggtgttcacttaatctaatgatattcaatattttaatctagaggaaaatatccaaattccttatcactgtcttcctttatctaatattgtgatagtaattccaatttaaaaataattcttatcagtagataacacgcagggaaaatacaataaggcccactaattttgagagaaactacttcaatataccatgttagaacctatattgtatttcacttgatagagaaatattacaaaattaattagtaccattgccttaatcaaaactctgctgactgcaagcaatagaaactaatatgagtgaatttaagagaaataggaaatttaataatagatgttgagttatccaaggaactgaagggcagaagagcctctcttgagtagagtcaagacaaagaaaatcattaggattcctagctataataatctgtctctttgctctgtttttctctgaacgtctgtctcactacaaagaagtttgtagacagacttcttttgcttctttatatccatgacggaaaataattactaacaaatactaagtttattatcaacattgtttcatctattcaaattgactatctgtgaccctcagtttcaagttcttgatacattttttttgttctcctttttttttttctaatttgactttgacactctggtaatcatcagtaataccattcaccaaatatttctgtcttggtttccaccttgcaagcatacgataggattttacttcctagctccattgcagttgggtgagtccatgtgatttattctggtcaatgagctgtgagcagtagtgatgtgtgtcatttaaatatcaggaagggactctatagaggcagattttcctctgttttgatgatcagtaatgttacagttaatggttgctttatcagcctgagttcatgaataaagagaaggcaaattaaggtccccatccatccttcaatggagccagaaataaactttactgttttaagtcactgggattcggggatcgtttgtttgtctgtttgtttgtttggttttagcagacacagccaagctgtttggactaatatatacatggaattgtgttagatttgcaatattagcatttagacttgatgtgttattttaaacccctgggccactattttgttcctctgtttactctgcattcacactattttcttgcctttggttcagtacccattttcttctgtcatgtcctgttgctgttgtaagaattctcagaggataatagacaaaggcattaaagtgtattggaacaagcactgacctatgagttacgatacatacattcttttatgcatctatcagccatgtgacaatgtggcattttataatttgggagttcagtttcttcatataaaaatatattatactctgcctacctcaatcagagtgtataaagagtaacatactatattatacaaatatatgttctattgtctatcaatctaggtatctatcatctatttttctttatataaattccttaggtatattttcccaaggtgtagctgagaattattttatttgctcggtttagccaataaatatgcaagcatataaatttataaataatgacaatgatatgtaacaaattggtagtaattactttaaaatactgtaattgcttctaaacttttgtttccttactatttctgaaattatgcttgaatatagtgatgaaaccaaatgataattcatatggatcatgtctaggtggagatttaactgtgttgcccattgagtgtcaatagatagcactaagtttataccattacatctatgtttctgattgcacactgtgatctatcagtcaagagcagtggcatgagatttggaagacaggagcagtctttctgtcctctttgagtgtcattctgtgagaaacaaagtcctggagaagtgaagtctgtctgcagctgcttctcagccttcattcttcagcttttgctattgagagggacatatctggcataaataataatatctttttaacttcagcatcctgacaccttgcagttatagcttatgttcttgaaaccagttgttccagtagtagataaggaggtggtaactttagcaggtcagttctttttctgttctttatttttggaggcacggttcagaggttgctcttgcagctttctcaattatactgtaagcacctaacctgtattaaatttactcttacataaaatatttagagaaatagttctaaaactttgatatgcctcagtatgaggtggtgggcttttaaaaaatcatattatctggctttgctgccaaaattccgatttattaggcatggagtaggatccaagaatatggctatatgagaagttcccagattgctgaatcatggaccacacttgaagaaccatcaacttagagtattttctgttcctattcagaatctgtaattaaatagaccttgtcctcagatgtatcaaataatctaggccaaccacaattatttctgaaacattcaataattgggctcattattaagtgttgcatcctaaatagacactgttaattgagtttacaacaaaatgcttatcaataggtttcaatacagatttaataatcattaaggaattctagaattacttatgttcagtgtatattttaatttttattctttgcaataaatcttgtttcagtgatgtcatacagtaacagtatcatacagtgacatatacttctttttttcccctgatatttctgccatctgaatataaattaagctcagacaggtaatatttttgtcactatggatatttttaataacttctgtttttaaaatagaaatttaaacagagctaccatttaaaattttgtcattatttcatactgtatatatggtaaatattctcattttaaattttagtttaatcatgatattttaacttagttcaactccatatattttatataaggattttgagatccaaagataaaagaacttagagaaagagttgaagctataaactaaatcatttcacacctagtccagtaattaaaaattaatacatattaattttagagcagttttagattcacagcagaattctgcagaaagtacagagagttttcatatacatcagcccttgacactcccagttttgcccactatcaacacaccacatcagaattacccatttgttacaatcgatgaacctacatcgaaacatcaaaatcattgtttccattagggttcgctcttggcgttgtacatcctgtgagtttagacaaaagtataatgacatgtagccaccattgtggaatcatacagaataattttactgccctaaaatcctctgcactccacctgttcatccctccttccccttttcttcatctattgatacaatcatttgattttttcttctttcacctggtaatacgataagcttatttttgaattttgaaccagtctgcatgtatgagaaaactcccacttcgtcatggtgcataattctttttataccttgatgaattttgtgtacttatattttgtttaggatttctacatctatgttcatgagagataatggtctgtagttttcttttcttgtaatgtctttgtctgggtttggtattagattaatactggccttacagagtaagttagaaggcatttcttcgtttctgtcttctggaagagattgtagagaagtggtataatttcttcattaaatgttttatagaattcaatagtgaacccatctaggctgtgtgctttctcttttggaaggttattatttatgcaatttctttaatagacatggccttattcagattgtctatgtctactagaaaaaattatatttctttttgtgtaaattttggcagattttgtcttttaagaaattgataaggggtccgttcaaaaatggccgaataggaacagctccaatctgcagctcccagcgtgatcgacacagaagacgggtgatttctgtattttcaactgaggtacctggttcatctcattgggactggttggacagtaggcgcagcccatggagggtgagccaaagcggggtgaggcattgcctcacccaggaagtgcaaagtgtcaggggatttccctttcctagccaaggcaagccgtgacagactacctggaaaaactgtacagtcccatccaaatactgtgttttccccacagccttagcaaccagcagaccaggagatcctctcctgtgtctggctttgcaggtcccacgcccacagagccttgttcactgctagcgcagcagtctgagattgacctgcaaggctgcagcctggcgggaggaggggtgtctgccaatgctgaggcttgagtaggtaaacaaagtggccgggaagctcaaactgggcggagcccagctaagtccagcaaggcctactgcctctatagattccacctctgtgggcagggcatagcagaacaaaaggcaacagaaacttctgcagacttaaaagtccctgtctgacagctctgaagagagacacacataggctcaaaataaagggatagaggaagatctaccaagcaaatggaaaacaaaaaaaagcaagggttgcaatcctagtctctgataaaacagactttaaaccaacaaagatcaaaagagacaaagaagctattacataacggtaaagggatcaattcaacaagaagagctaactatcctaaatatatatgcacccaatacaggagcacccagattcataaagcaagtccttagagacctacaaggagacttagactcccacacaataataatgggagactttaacaccccactgtcgacattagacagatcaacgagacagaaagtgaacaaggatatccaggaattgaactcagctctgcaccaagcagacctaatagacatctacagaactctccaccccaaatcaacaaaatatacattcttgtcagcaccacatcacacttattccaaaattgaccgcatagttggaggtaaagcactcctcagcaacaaacaaacaaacaaacaaaaaataaatcacaataaactgtctctcagaccacagtgcaaccaaattagaactcaggattaagaaactcactcaaaactgcacaactacatggaaactgaacaactgctcctgaatgactactggataaataacgaaatgaaggcagaaataaagatgttctttgaaaccaatgagaacaaagacacaacatacgagaatctctgggacacatttaaagcagtgtatagagggaaatttatagcactaaatgcccgcaagaaaaagcagaaaagatctaaatatcaacaccctaacataacaattaaaagaactagaggagcaagagcaaacaaattcaaaagctagcagaaggcgaaaaataactaagatcagagcagaactgaaggagatagagacataaaaaaaccccttcaaaaattcaacgaatccaggagctggtttcttgaaaagatcaacaaaattgatagattgctagcaagactaacaaagaagaaaagagagaagaatcaaatagacacaataaaaaatgataaaggggatatcaccactgatcccacagaaatacaaactaccatcagagaatgctataaacacttctccacaaataaactaggaaatctagaaaaaatggataaattcctggacacatataccctctcaagactaaacaaggaagaagttgaatctctgaatacatcaataacagcttctgaaactgaggcaataattaacagcctactagccaaaaagtccagaaccagacagattaacagccgaattctaccagaggtacaaagaggagctggtaccattccatctgaaactattccaatcaatagaaaagagaggctcctccgtaactcattttatgaggccagcatcatcctgataccaaagcctggcagagacacaacaaaaaaagagaattttaggttaatatccctgatgaacattgatgcaaaaatcctcaataaaatagtggcaaaccgaatccggcagcacatcaaaaagcttatccaccacgatcaagttggcttcatcccggggatgcaagtctggttcaatatacacaaatcaataaatgtaatccatcacattaacagaaccagtgacaaaaaccacatgattatctcaatagatgcagaaaaggcctttgacaaaattcaacagcccttcatgctaaaaactctcaataaactaggtattgatggaatatatctcaaaataataagaactatttatgacaaacccacagccaatatcatactgaatgggcaaaaactggaagcattccttttcaaaactggcacaagacagggatgccctctctcaccacacctattcaacatggtgttggaagttctggccagggcaatcagggaggacaaagaaataaagggtattcaactggcaaaaggggaagtcaaattgtccctgtttgcagatgacatgattgtatatttagaaaaccccatcatctcagcccaaaatctccttaagctgataagcaacttcagcaaagtctcaggatacaaaatcagtgtgcaaaaatcacaaaaattcctatacaccaattacagacaaacagccaaatcatgagtgaactcccattcacaactgctataaagagaataaaatatctaggaatacaactgacaaggaatgtgaaggacctcttcaaggagaactacaaactactgctcaatgaaataaagaggacacaaacaaatggaagaacattccatgctcatggataggaagaatcaatatcatgaaaatggccatactgccgaagggaatttatacattcagtgccatccccatcaagctaccaatgactttcttcacagaattggaaaaaactactttaaaattcatatggaaccaaaaaagagcccacatagccaagacaatcctaagccaaaagaacaaagctggaggcatcacgctacctgacttcaaactacactacaaggctacagtaaccaaaacagcatggtactggtaccaaaactgatatatataccaatggaacagaacagagccctcagaaataacaccacacatgtacaaccacctgatctttgacaaatctgacaaaaacaagaaatggggaaaggattctttatttaataaatggtgctgggaaaactggccagccatatgtagaaagctgaaactggatcccttccttacaccttacacaaaaattaattcaagatggattaaatacttaaatgtaagatctaaaaccataaaaaccctagaagaaaacctaggcaataccattcaggacataggcatgggcaaatacttcatgtctataacaacaaaagcaatggcaaaaaagccataattgacaaattggatctaattaaactaaagagcttctgcacagcaaaagaaactaccattggagtgaacaggcaacctacagaatgggagaaaatttttgcaatctacccatctgacaaagggctaatatccagaatctacaaggaacttaaatttacaagaaaaaaaggaacaaccccatcaaaaagtgggcaaaggatatgaacggatgcttctcaaaagaagacatttatgcagccaacagacacatgaaaagacgctcatcatcactggtcatcagagaaatgcaaatcaaggccacaattagataccatctcatgccagttagaatggcaatcattagaaagtaaggaaacaactgacgctggagaggatgtggagaaacgggaatgcttttacactgttgatgggagtgtaaattagttcaaccattgtggaagacagtgtgtcaattcctcaaggatctagaactagaattaccatttgacccagtgatcccattactaggtatatacccaacggattataaatcatgctactataaagacacatgcacacgtatgtttattgtggcactagtcacaatagcaaagacatggaaccaacctaaatgtccctcaatgatagactggattaagaaaatgtggcacgtatacaccatggaatactatgcagttataaaaaaggatgagttcatgttttttgcagggacatggatgaagctggaaaccattgttctcagcaaactatcacaaggacagaaaaccaaacactgcatgttctcactcataggtgggaattgaaagtgagaacacttggacacagggcgggaaacatcacacactggggcctgttggggggcggggggctgggggagggatagcattaggagaaatacctaatgtaaatgaccagttgatgggtgcagcaaaccaacatggcacatgtatacctgtgtaacaaagctgcacattgtgcacatgtaccctaaaacttaaagtataatgataaaaaaagaaattgatctatttcatctaggctattaaattttggggcacatagttgtttatagtatcctttattaccattttaatgtccgtgggatctatgatgtaccctctttcaattctgatattagtagtttgtgtcttctctctcttttctattttcttagtctgtctggaggcttactgattacgttgatcttttctaatatcaatttgaattaaaaaacccaccagttatttacattgtctatctctattgatttcctgtttccaattttattgatctctgccccaatcattattatttattttcttctgcttactttaatcttactcatctttttgtagtttcctaaggtggaaagctttgactattgagttttagatcactgctcttttctaatagatgcattcaatgctataaatttctctctatgcactgctgtgcccttacaaattttcatacttttttttcattttttattcagcttaaaaagtttacattcctcctgagatttcttctttatttcatttgttatttagaagtgtattgtttaatttttaagtattttgggattttctggctactttctggttattgatttctagtttaattccattgtggtatgagggcaactattgcataatttctatttttttttttttacttttaaagaatttttttaaaaaatattttaaatgttatatttgtttaaatttgttaaattgtgctttatggcctagaatttgttccctctttgtgaatgttccatatgagcttgagaagaatgtatattatgctgttgttggataaagtagttatttcaattatatccaggtgattgatggttctgctgagtttgactatgtccttattgattttctgcctgatgcatatgtccatgtctaattaaggggtattaaagtattcaattatgtaatagtgaatttgtctatttcactttgcaaatctatcatgtattttgagcctcacatattttgatcctctgtagttaggtgcatacatattaagggttgttttgtcatcttggagtattagtcaccctatcattatgtaatgccattctttatcccttataatttgtcactgataactttccttgctctgaagactgttctgtctgtggttaataatgctacttctactttctttgatttgtgtttgcatggtgtatattcctccatccctttattcttaatctatacgtctttatctttatagtgaattacttgtataaacgtaaagttgggtcttgttttgatcccctctgacaatcaatctctgtcttttaattggtgcatttagaccactgactttcaaagtaattattgatatagttggattaataactaccatatgtgttacattttctatttgttaaccttgctctttgtttctatttttgtctttcactttttccctgccttttcttggttttaatcaattttctcacatttattcacatatccattatacttattttaaaactcttttatttatttatttatttttgagacagagtctcactctatcgctcaggctggagtgcagtggtgggatctcggctcactgcaacctccgcctaccgggttcaagtgattctcctgcctcagtctcctgagtagctgggattacaggtgtgcaccaccacgcctggctcatttttgtatttttagtacagacagggtttcaccatattggtcaggctggtcttgaactcctgaccttgtgatctgcccacctcagccttccaaagtgctgggattacaggcatgagccaacgtgcccagccttaaaactctttaagtgttttccttggagtttgcactgcacatttacaagttatccaagtccattttcaactaatactgtatcacgtcacaaatagtgtgattaccttataataacaagatattcttaatttcttctccctgtaccttttatcattgctgtcattcatatctcaaatatttatgtatcagcatacataagcatatatgtacacataaagcatgtacataaacatacataatcaaatacactgctgctattatcatcttgaacaaactgttatctgatagatcaattaagaataagaaaaataaaagtttttaatttaacgttcacttaattccctttctgatgctcttcttttctttatatagatctgagtttctgacctgtacattttcattctctctgaggaatgtctttcaacatttcttgcaaggtaagtctattggaaacaaattccctcaattctttatttctatttcacttttgatgaaaatttttcagggtaaggaattctaggttgttgtttctttttttccccctcccaacactaaatatttcactctactctcttcttacttgtgtgtttcctgaagagaagttatatgtaattcttatctttgctcctctgtatgtaaaggttgttttatttttcacctttgtcttttttcaaggttttttctttgatattctgaaatttaaatataatatgcctatgtatagtttttgttttgttctgtttgaatttacctggcttgatattttctaagcttactggatttgtgcttcagtgtctgactttaattttgggaaatttctgtcattattgcttcaaatattgtttctctttctttcttgtttgcattttcattgcgcatatgtcacacctatgtagttttttcataattctggaatattatgttctattttattaatttttttctttgttttacagtttttgaagctttttttgttatatccacaggctcagagattctttccttagctccgtccagtctactaaggagcccatcaaaggcattattcatttctgttacagtgtctttgacttctaacatttctttttggttctttcttagaatttccatttgtcagtttacattatatgttggttctcacatgtcagatttttcacccttagcatgttattaacatatataaatatatataggtgtatatttttaattccttatttggttattccaatacttttgccacatctgacactagtctgatgattgttaaatctcttcaaactatagttttttttttttaccttttagtatgacttgtaatattacgttgaaagatagacatgatatactaggttaaaggaactctagtaaataggcatttagtggtgtgatggtatattttaagggaaggggaagcattatatactcctatgattatgtctcagacttctgatgaacttgtattcctgaactttgaactccaccagcgcttctaagttttctttctttttttgtgcatgtgtgtttataaaaaattagtagttttttctttttttttcttttttaaaatttttttaattattattatactttaagttttagggtacatgtgcacaatgtgcaggttagttacatatgtatacatgtgccatgctggtgtgctgcacccattaactcgtcatttagcattaggtatatctcctaatgttatccctcccccctccctccaccccacaacagtccccagagtgtgatgttccccttcctgtgtccatgtgttctcattgttcaattcccgtctatgagtgagaacatgagttgtttggttttttgtccttgcgatagtttactgagaatgatgctttccaatttcatccatgtccctacaaaggacatgaactaatcattttttatggctgcattgtattccatggtgtatatgtgccacattttcttaatccagtctatcattgttggacatttggcttggttccaagtctttgctattgtgaatagtgccacaataaacatacatgtgcatgtgtctttatagcagcatgatttatagtcctttgggtatatacccagtaatgggatggctgggtcaaatggtatttccagttctagatccctgaggaatcgccacactgacttccacagtggttgaactagtttacagtcccaccaaaagtgtaaaagtgttcctatttctcctgttgtttcctgactttttaatgattgccattctaactggtgtgagatggtatcttattgtggttttgatttgcatttctctgatggccagggatgatgagcattttttcatgtgtcttttggctgcataaatgtcttcttttgagaagtgtctcttcatatcctttgcccactttttgatggggttgtttgtttttttcttgtaaatttgtttgagttcatcatagattctggatattagccctttgtcagatgagtaagttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcccgaatggtaatgcctaggtttttttctagggtttttatggttttaggtctgacatttaaatttttaatccatcttgaattaatttttgtataaggtgtaaggaagggatccagtttcagctttctacatatggctagccagttttcccagcaccatttattacatagggaatcctttccccattgcttctttttctgaggttagtctaagatcagatagttgtagatatgtggcattatttctgagggctctgttctgttccattgatctatatctctgttttggtaccactaccatgctgttttggttactgtagccttgtagtgtagtttgaagtcaggtagcgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcattatagccattttcacgatattgattcttcctacccatgagcatggaatgttcttccatttgtttgtatcctcttttatttcatggagcagtggtttgtagttctccttgaagaggtccttcacgtcccttgtaagttggattcctaagtatttgattctctttgaagcaattgtgaatgggagttcactcatgatttggctctctgtttgtctgttattggtgtataagaatgcttgtgatttttatacattgatttttgtatcctgagactttactgaagttgcttatcagcttaaggagattttgggctgagacaatggcgttctctagatatacaatcatgtcgtctgcaaacagggacagtttgacttcctcttttcctaattgaataccctttatttccttctcctgcgtaattgccctggccagaacttccaacactatgttgaataggagtggtgagagagggcacccctgtcttgtgccagttttcaaagggaatgcttccagtttttgcccattcagtatgatattggctgtgggtttgtcatagatagctcttattattttgagatacatcccatcaatacctaacaaactgtctctcagaccacagtgcaatcaaactagaactcaggattaagaaactcactcaaaaatgctcaactacatgaaaactgaacaacctgctcttgaatgactactggatacataacgaaatgaaggcagaaataaagatgttctttgaaaccaacgagaacaaagacacaacataccagaacctgtgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatgagagcagaactgaaggaaatagagacaaaaaaaaacccttcaaaaaattaatgaatccaggagctggttttttgaaaggatcaacaaaattgatagaccgctagcaagactaataaagaaaaaaagagagaagtatcaaatagacacaataaaaaatgataaaggggatatcaccaccgatcccacagaaatacaaactaccatcagagaatactacaaacacctctacgcaaataaactggaaaatctagaagaaacggataaattcctcgacacatacattctcccaagacttaaccaggaagaagttgaatctctgaatagaccaataacaggctctgcaattgtggcaataatcaatagcttaccaaccaaaaagagtccaggaccagatggattcacagccgaattctaccagaggtacaaggaggaactggtaccattcctctgaaactattccagtcaatagaaaaagagggaatcctccctaactcattttatgaggccagcatcatcctgataccaaagcctggcagagacacaacaaaaaaagagaattttagaccaatatacttgatgaacattgatgcaaaaatcctcaataaaatattggcaaaccgaatccggcagcacatcaaaaagcttatccaccatgatcaagtgggcttcatccctgggatgaaagcctggttcaatatatgcaaatcaataaatgtaatccagcatataaacagaaccaaagacaaaaaccacatgattatctcaatagatgcagaaaaggcctttgacaaaattcaacaacgcttcatgctaaaaactctcactaaattaggtattgatgggatgtatctaagttttctttcttgcttaggtaggacaggatggctacagtggactgaagttgggtatttcctttcctcctggtatgttagactctgataaaactccaccatgttagcctgtagtaaaatagtttatcatgaggacaggccttgttaagaagaacagaatgctctgttgtattttttaaatggttactttttccctccctcttctggaagcatacgagaatttttctccaatatttattgtgaggacttggtagagtttctagaggtaaaactcacaaaagggagagggcacctttgtgactgcgtccttctggagtttttaacactcagagttgtccatagtcaacctccaggtatttgtcaattagagttcaagttttcctatcccggcactggttctcatggacatttcttctgtgtagttcctgcttaataagttgtgattctccacttctatttgtctgtctctacaattttgggggcagtggtttgccctgtgatctcacttctctgacagatctaagaagagctgttaatttttcagtttgttcagctttttacttattgttatgatgtagtgctgactaccaaactcctttccagtgttcttttcattattgctacaaatcttcttggagtgtagatttcatcattacctattttatctgtgtgtgtgtgttcaaattagcaataaaaaatttgctatgtttggaacaaacaggtttggttttgttttgttttgagatggaatctcgctctctcgccagactggagtgctccagttgcaacctaaatttttaaagcttttcacaccttcatgaaaggctttcactgtgttcctggttcatcatgatgttgcctagatcaccatggaaggatattttccatggaccagagctgacaacagaagcaagaatgaaccaaacacctttcagttgcccaagagactagactgtattagaaagttccacattattatatgttttttaattggatgtgaaagcatatcagaagagattgaaaatcatcccaagttgatttaaaaataacaaagcctcaagaatagtcaattaatggtgagttgtttattcttttcaattgctttaatcattgtagaaaagaaaagcaatttttaaagaaaaaaataacgtttgagaaatgataaatatggggaaaaaataaaaagaagaaactaaaatgtattttgttatccaagacctggggagagaagctattgactgctgagttcaattaagtttcagagaagaaagtcagaattagcaaatccttaacaggccactctggcaggaaattaatttttgattaaataacatgattaaagagtgagggagtttaattcatagggatatattggatgacttccaaatatattacttctttctaataattaaagagtaacttaaaatggcattaaatcatattttaaacagcataataataacaacttaagattggcagcagcagctagtaatctctgtttaatacttaaatactaggttgggtttggcaatgtaatcatactagtgattttaaaaaaacttttgttcgggctgggcgcagtggctcacgcctgtaattccagcactttgggaggctgaggcgggcggatcatgaggtcaagagattgagaccatcctggccaacatctctactaaaaatagaaaaattagctggatgtggtggcaaacgtctgtagtcccagctacttgggaggctgaggcaggagaatggctggaacccgggaggcagaggttgtagtgagccgagattgtgccactacactccagcctggctacagagtgagactccttctcaaaaaaaaaaaaaaaaaattgatatgtttagagttggtatgcattctttcctctggcattgtccttagtcatactattgcttgtataataaatataaattttaagtctatttaaagtgttttttgtaaatctcttcttaaagtttaattaagtaaaattgaattccagaaattaatcctatcttaattctttttgccaatcaataattagtaatgaaactcatattccttatttaaaatgacaaataagtgttgaaggacaaatgagagcatctacaccaaagtctgcaaatatgatattgtaattcataagtaagcagtagattcaaacttttttgggttaatagcatgaatcataacctcaaaaaaattggcataatataacccaaacatcataatattaaggtgttcagggagcatctcatgggactccatgttaagaccactttaaaacaagcatttccactcttgtcctctaagacaggtgacagaagtaagaatattggaaatatgttaaagacaaagtgtaccacaaaaattataacagaaatatactcttaatatctttaaaatttaaagataatcaaaatcataagataaagactccaataggtaagtgatgactctgatttcataataaataaaagaagaaacagtgaagtaaaacatggaaaaatgtttattttttataccggggctgggactacggtaaagcaagcaagatacctaggacacaaaatataaaaagggagtctctctctaggtcatgtttgttcagagtcggcacacaaggatgagtacctccttacattttgccccttcgatgcttcacttgcgtcactctagtcccagctctgctttgcactaatcaaagaaattcagattacaggtgggctaatcagtctacccctactcctggtattcatggctttgtatatggtattcataaacacatgccattccatgatcattagaatatgcctaaagcgatggcatgtgataattaggctactgccttactctcacttcttggggaagctctcactctgagggaagccagatgccgttttgtaaggtcacacaaacagctctatgcagaagtctaagagataaggaagtgaagtctcttgccaacagccatgaaggagccattgtggaagcagatattttagctgctgtcatgctttcagataactgtagcctcagccaacatcttaattacaacctcattaagaaaccctaagccgtaattttttattttggctactcttgaattcctaatgcaaataagcttatagataataaatgcttatcattttaagcattaagccattctatcatttgtacgtaaagagaaagaaattctgtgttggtgttacagacttgtcttagcacaatggttacaaatacagacccttgagccaaactgtctcactttgaattttggatttgttgcttattagccgtgtgtcctgtggaaaatttctgaacttatttgtattttacattcttcatctatctgtaattaggaaaaataatagtacctctgcttcaggactgatgggaaaaattaagaaagtgaatgcatataaagtatctaccaattaatatacattatacgtgtgttttatacagttaatttttctgtgcttatttctcatgcagacatgtgtattgtcaccaaagagtgaagcacagctttctttatgggcaaatatatttcactaataccttcttcactaatacctcagatagatgtgcatggctcttgaaaaagtattttgtatattcagaggaggagaagtgggatttctcccactttggttttaggtggggaaaattttctagattaagtacaggaaaattttattttatggttatttccttcttgccatattagaaatgctcccagttttattgtccaaatatttaatgcctacaacatttgccatgcacttccctggaaatgaatcttttcttctctcacattcatttttcgtgtgagtgtgtgtgacctacatgcattcttttctctttaaaggaatgtttttactgctctgcagacatcaagtagcctgagctggaggttaccatggtgatatggtcatacacgatgacttcaagtctatatcttgctgagtggttttcagggagaattgaggattgttgtcttttgctgatagactctacttaaacttgaccttctctgccatttcttctaagaataattaaataatcttggtgttagtggatgtccaggatggctgttttcaaaagtataaagtaggtaacatttataatctttacactttccttttcttgtaacctttccccagcaacagtattattcattttctctaggcatttgatgacctaatattacctcagacctttttaacaagaaatatgtgaatctattaatcccatttatactgtgatttaaaaatcaaaatcatatcactatatttgagttgcattatgtagactcacctcagaaatcatgactgtacagtgagttactttagagaaaaaaaatttgggggtaagtgacactggtggtagaaatctctgtgtcaaaaataggcaataaattatttttagtttacaactaccatcatgcattgcttgatgacagatacacagcctgagaaatgtgttgttaggtgatctagtcatcatcctaacaaaataaagtgcacttacaaaaacctagatagtctaggctatgctacacacctaggctattaggcatagcctatttctcctaggttacaaatctgtacaccatgtcactctactgaacactgtaggcagatggaacacagtagtaagaatttatgtgtctaaacatatctaaacatacaaaaggtctggtaagaatatgttgttacaatcttatgggaccactgttgtacatgctgtatatatggtctgtcattgatcaaaatgtcattatgcaatgcttgactgtataaaacatataactagttttcaaattattcccagtatatacatatatatatcagaacaaccaaatatatccatttctactcaaaacagaacagttttttctctgtcccaaacacttactcgacttgaaaatggcttcagtttaattatcttttcttagtaagtattgtttacattaaaacttttttgaattgtctaacgtagttctttagagtttctcaaagttttgttaccagattatatatcaagttgggaatcaaatttttttaaaaatgcaattacatttcaataatgaagaaaacagaaataaatattgccaataattatcttgtaacataaatagatttgaatattacaatagttcttattatgtgtatcagtcatttttctctcatctaacatttaccaccaagtatttacttagcttttcatgtgttcatttgtgtcctcatataaaggcacaacttcttgattttaggaatcatgcctaatattttgttgtttgtttccagataacacttaattagcaatttagtaaacattaattgaatggaaaatttgtttagaaacaattaaagtatgaaaagtttcagggaaagtgatttctcatctttttttttttgttagtttggcactagttcttcaagttttatttcttctttggtaaagagggataatgtgtttatttatgtacttaacaaattctaactgagtactagggtctgttctttgagatgtgaacctaggtcagaagaactctacttttatgaagcttgcattagtgagaggaaacaaacaaataaataagcacttacacaatatataattccaatgaatataaagaacttcatgatacagtgactgtggagctatgttagtagactcatcctctctgaagaggtgacgaagaaccagaaatagctaggtgcatgcaaaccagaagcagtattagttagggcaaacttaagtatgttgagttttaagataaaaagaaggccaatgttgctgaagtataaaggacaactaattagagaagaggctaattagataatgtcaaagaaagagactatggagtgttctttgtaaactggggtaaagaatttggatttttttttaaagtacaatgggaatccattggaagtttttaaggaagaatgaaacaaaatctaatttacatttttaacagtttttaaagtactaggttatgaggtagggagaaattggacagctaagtctgaaatatttacttgacattcatgtccagatatcaggtggaaagttgttgtctaggactccagacaggttctaggtcagggctggagcccttgatatttagttggtatttaaagccatgaatcctatgagataagctagaaatattaccttgtgggaacattgagagtgacttaaaacagagcctcaaagcatccagcttttagcagtttagtagagaagaaaagatcataaaggagcagtgtagcaagacagagcaaagaataagataagaggcaagaggagagaataaagttaatacggtaggcagacagaagcataagtaagatataaacagaaaggtgaacatgagatttggtttcacagaagttgttggtggctttgacataaacaataccaaatggagtaatgaggacaaaaccagactagagtgagttttcctatggcactatgaaaacaatgaaaagatcaaaatgtgatgtgtgcctcataacgtatgtagtagtaataggactgctaattgaataaaaacagcaattatgtaatgggtgttagctttccatctgacattttgctaagcacttttcatgtattattttatttaatccttataatagcactttaaaatcaacattattatgtatcatcattttagagataaggaaatagacatctttccaaggtcacattgctttgtcacaagcataagagttacagaatcagtcttaatctaaagaaataaaaggagcagataattattgtgtatatttattttttataaaattttgttttttaaagtagcatttcacttatgctaagttctgtttttagagtttatttgcataattgaatcacagaaaagtgataatctcctcagcaagataaacaattgatggctaccgaatgaatgtgatgtttctgattttttagttctaaaattcaaacctggaggacttaaaaatatctctaaaatgtatttgtgtcaaaacttacagacataaagaatgtatttcggactgagagaaaaagtataaatagcttcttacttaattcctttttttctgagaattacagtaaaatagctagaatcatctatatttaaccagttaagattcttgaaatcaacatgagtgattttaagaataatcaggctaaaaacacttataacttgtaaaaaatgtatcttaaaatggaagtgtgctgtaataatagattgtgttgtgctaattaatgtaaaataattggctacttatactaatttcagaaagattatagaatgaaacattaaaacaaacacaatagaaaatgtagtcttttaaaaaataatataggattgagggcgacatgaaagaaaataagaaagtattgacagatttgactaaacaattttcttcttaaatcaccatacaaaagttaaaaaataagtgaataactggggaaaatgtgtatagcatatataaaagacaaatggatattatctacatgaatagcctttgcaaataaatgaaagaaaaatgagcagtccaacaaaaataaagcacaaatatgaacaggcaattcacagtaggcatgatgtccaaagaacttattaaaagatgttcaatctcagcaataatgcaaaggatatatttgaaacaatgttgaagtagttgactccactccgtttaacaaaaagaaagaaaaggaaattactaataataactagtatttgccagggtgtggggacacagacactttcaaactttgtaagcaggagtggcaaacatttgttttaggggaattttcagaaaaatctccaattaatgaaagctgagtaatttcttttcttctaatgggactggataatacgagtcctacagatatcaattgtaaatgaggtattccagttgtcaccggaatggagtgcttcttctccaaggtagaggttctcactctggctgcacatgagaaacacatggatatcatttagacaataccaacgctggatacctccaaccaatcagctcaaaatctctggaactggagcatagatattgctaatttttagcatactcccaggggattctaacgagcacaaggttgagatctctgtcattattatcctcacctttcctattagggagagtaaaaaatgtatctaaagcccattcttgagcctctagtgttcagcaaacttgctaactaaacttaatggagagaaaagtattttatttctcagctgagcatgtataaagagattttgcttaaatagaggcctacagggaaaaaccctgagaggctggctacatttcattgttgacattgatctctgtccagggaaaatgatcatggaccaaagcatctctccttccttccttcctttttttttttttttttttttagatggagtctcactctatcaccaggctggagtgcagtgacgccatctcgactcactgcagcctccgcctcctgggttacagccattctcctgccccagcctcccaagcagctgggaccacaggcatgtaccaccatgcctaactaatttttgtatttttagtagagacagggtttcactatgttggccaggatggtcttgatctcttgacatcgtggtccacccgcctcagcctcccaaagtgctggaattacaggtgtgagccaccatgcccggccccttatttttccttatttaccttttaatatgtctggaatttaggactcttcaaaggagtacactctcaccttcagggacaagactaaaatcagagtggataatattcaaacattttaggtactctatgtttaatcaggactaaaaggcagatgaaggcatttaatttcattttgttcctctgtgccttgcaatttccttttcattgcaattatgagaatcacaatatgatccatctgagagagaggctgactcaattatggcagtctccaaaacaatatagttacagtctatttgaagacattttggcaataactgctttaaaattttatataccctttatgctagcatttccactcctagaaatttattctacagacctctcacaattgaaaagaattcttgttcaaggcaattcactgcagcattgcttgcaataccagaacttggaaagaaattatacagctattaaaaataatgagaaagatgtccatgtattgattttgaaagatatccaggctatgttgaccaatgaaaagaataagtacatttttgtgatttctaaagtatcaatttaattatgttctcccaactcttttcatgaatggtttcaggttatagttggtcaaaagagtaatttgcttgagatctggaaagcagaagcaagcaatggcttcattttcttatggtcatcatggttatctgaaatgacagacaaatatagaggtgcctgttgggctttagcttttccctatgcatctcaactatgtgtcaagctcttcttttggactcctggccttgctgaccgtcagtctcagacccagacaagaggtacacaaatgctggcaagtttctgcttggctttgttccagtgtctgtctagttcttctctccaattgcaggccctagtgaccatccgtggcccgaagttcatcaccagataattacatgggaacccataaagataacaccttcctgtaggtatctccacccactcctcttttatgatccttttttggtggttgaatctatgtggcatctcagattgactgtggatgacacctctgatcctccaacctcccttttcagactttaattttcaagcttctcccacaattgtttaaggtctcattcctacaaaaaaaaattcttattctgtaactattctacaacttattctataactgtaatattaactattagtgattcactgattgtgtcctgactgacacagttattgggactggggtatataatctccatatgtagctttcaataattcctccctttgttgtacatgcacagactcgaagaaatttggtctcctttctctttccttgagcctgcgctggactatcacttgcttaaactaattgaatacagtggaagtaatattcttggatttctactctagaccttaaaagatactacaacttttattccttcttcttggatctcagcagccatgatgtaaagaagtccaggctagatgatttgataattagaagtaatatagaaagacacctgatgcatgagaaatccacttagtacatttggttagtacgttgggacctcccagctggctgcagctagctacatatgagtgaatccagctacaatcatgtatagtagaataaccactcaactgagcattgcctgagttcttgatccatagtcatgaaaaataacaaatcattgttaaattaatttttaagccactacattttcagttggtttgttacacaaccatagatacatccattcatacactcattcatccagcacctataacatcaggcatcattgtatatactgagcacacagtgctgaacgagatagataaggtccttttgttttgcagattacattttagtggagataagtaaagaaaattatttcaggcagtgaaaaggaatttaaatttttgttgagctagagttggttgagtggaaaagaccatctttgattaatgctgaaggaagacttctctgaggagatgccctctgagttgagatctggagaataaggctctcattctgcaatgaattggaaggtttcagacagagaaaattgcaaagtaaatgggaatatttcccgaacagaagtaaaaatcatatggctgatatgcagtgaggaaggggagatgaagttctttagtaatctctttaacatcttattatccatattaaaatgctttgattttattctaaagtttaaaactattaggcacactatagacttatttaaaacatattcaagcatatgaataaagtgagttggaatatgtaacaaattcttgacagtagttgtttctgaggggcagttttaagaggaatttttacttttaaaggcatattttcatgatgtttcaatgttgtataaatgtggaacagactttttcctcaaaattttattctctccttttatattaataggattatcatcatgaacatgttgagactatatatttctaactcccttgtggacaaagtatagttatgcagctaaatatgtgaatggaaatgaaatgtgttattctcatctgaggcttttacagagtgagtaggtctcttccatgatttcttttccctagttttggctgcttgcggaggctgatgagaatgataaagccataagatgggaggaaattcagttcagatttattgcacggaggagagccacgctgatatatatgagccaaaaataaatgttagtcccctgaaattttggaatttgttaccatagcttagtctaacctaactaagacaatgaatatatgcattacttttgtaatctgaagaaaaaaagattaaaaagatttcatttaatgtaataatttctattgtacttcaagtcaagcctgaagccctcaaaagcttttctgcaaataggtcaaagaattagttggagtactagagcaagcatttaagcgtttttgtgaaacaatatttaatgctgctggtgactctgatcttacagtctatagtagatacataaggattcttgatattcctactccattaccttatatgtcaagaagcttctacttgtttgtatcaaggacttaggaagtagcattagattataccttttcaaaccagatttcactcagtgtatcaccaaaatgtggtaaaatatacatttgttacattgtcagcttttgagaccactattagattaaactgagagaaacgctcttactattcaaattaagtaacttgtgctctaaagatcaaacatttctaactatattactatgaacctggtactatctctatttacaacctcttattagcatctgtagcatctatgcagagaacttgaggacataatctaagtctgcatgcccatttagaaaacaatttatttaaggtcaggaaaattgtaaagataattcaaaaacaattctagaggtcaggcaaaacttgaagtttattctccctttaatttatagtctttctatcaggcccacctaaaatgtgaaagccttttctaacacctgtctgattgcctttggtaaagtgcaacaagctatgcctctttgttcattgtatggaattaaaaatatacatcccctattgctaacctaatatttctgaaaatcacctaatctagctctgttacttgttaaaaaaatgtaaacattgctgtgttgttacctctaatattaaaaacttcattttaaaaatcccgacaatttagcaaattgttgtatatctatataatgaaacataaacaccatgagaaatgtatagtttgaacactataacaacctagaaatattttgtattaacttaaaataaccaatagactaaaaattatatttgcaatgctgtgagtaaaactatgtataatattgtaatcatgtggctaaagagaagaaaacataatttaaaggcttgatttattaggatggcaaaactgtgggttgacatttgttcctttttatgttttattaatcgtgctataatgtttatgcattaggtaattcatttacgcaaagtcattcttcatttaatcatacagaattattaaggacctactttatcctaggttcttttttggtagttgggaatataatggttcagaagactaacaaactcactgcattaataaaacttgcattctattgagggagacatagagtcaacaaatatgtgacatagcttgctgtataatttgggtcttctagaaagaacacactaaaatcgagggtaaaattttaaaattttgttggagtgcaaaccagtgaaaccaatgaaggggaaaaacaggcagtgggaatgaacagaggtcagttatgatgctgtaattgacaatgtatctggcagtccacagaagcactccagaacaaaaaaatatccattagaaatggctaggtctctgtagtaacacatttctcagccattagctgatgtcacacagaacagagtatcacctatactcgtggagttaatggctgagaactgtcagaaaacgccattgctcatttctaggcagcagattatttcttggaagtgggtctgagagcaacatgtctttgttcactacatttgttatagatgaaaataaggtaagaagagaaagtgatatgggaagtttattttaaataagatgatgcaaaaggccattgataatatgatagttgagcagagacttggaagttagctttagtccacatgaaaatctgggcaaggtcattctgggagaggagacagaaaataagaatgtgataacctgggaacaagccatggctgaagtgaagaaaattagtagaaagagataggagatgagattgtgaagatagactaggaacataagggctacggttaggatattttctgagtattatggatggcccatggaaactttgaactagagagtatcataatctgttgtacatttttataaaattcacactggaggattgtgcctttcagtagagtgttagtggtagggccatcagaagaggtaggaatcagacatatattcaaaccatacctttctgatgagttggatatagaaaatgagggaaagagagaagtaaaggatggttccagagcttatgacctgaggaaatgtacagataaaggggaagaattgagtgaggaacaggtttgtgatcctgatggggagatagaattctgttttggatatgttaaatttaaggtgatcataagattctttgttgacatgtaaacagttaatgtgatatgggtttcttaaaagtcacaggacaagtagagtaacaattcagtttaggactcactaatgtacagatgacatttattgctacagatttggatgagatcacctataaaagtgagtataaatagagaagtatatccttgattaagccctaaggcactccaaaatctaaaagtaggtatgaagaggaggaggtagcaaaggagatggtgaaggagcagtcagaaaggcaggaagaacattagaagatgtggtgtcctggaaagccaactattaaaataaaaggaggagagggaataatcatcaatgtcaaatgcttctaataagtcatctaagatgaggacttggtgttgacttttggaaacggtaaaatggaagtcaatattgataggagaaatttcattggaatagaagggatgaaagcctttttggaaagcaagggtaaggaaaagggaattcgagcctgagaaaagagaggcaatataagtgtctgtgtgtatgtgtgagtgtgtttacattttatccctagaataggttgatttttaaaaggtacaatatattttgttttttgtactatattcatcatattcatatatcatacagatgagggatctgagttatagtcgagagagctagtaaagctagttgaattttatggtgctatagttagaatatagatagtggtaacctctttataaacactgtgttttggaaaaagagttcaaaaagttttggtaatacagaagtttctaccttcgatacctagagctaaatatatcaataatcaatataaattaaaaacatcttttgagtttggagcaacatccaatttgctttggatctttgcatctacaattaaaccagtaaaggagaaattgattggtagttatgttatagtaattgctttgagttcatacataccattattattagatggtttccatacaaattatctcactttatatgaaaaatgatcctatgaatgtcctttagagatgagaatactgaggctctgagctttaggtaacttgtgcaaaatcacgtagctaatttcacacatgaaatttgattgcaagtctgacagttagctctagcttattctagtatgcagtgctacttattgctttaaaattaccaaacagcttaaaagaggcaattatttatgctctgtgagacatcaatcaaaacttctatgtacttcagaatggattccaatttaataattaaaaatccaggaattatacatgtaaattgaagtcaaattgtttttcaagatagagggtcgttggctaaccaactacataacagttgatttaattagtagaaatgaatatcatgttaaaaatcttttcaggattatttatattctatatatgtttgtatgtttttagcatagaaacatacttgatgtttccttttttgaagacattcaattatatagctgttaacatctttaaaaccaatatatgtacaatatacaattatgaaattgtatataattttttatcttccctgtctggggaagaatagatttgaaattggtatttgaaatattgatgataatggaacatgttaacatatttgatattgatggataatgcaaagattaacatatttatttatgacagtctataaaatagtgatctgaatctacactgtaggacctattatgaatatactgttaaactgataatgcattccagagctatagcaactattacctaggtaaccacaaaaatatatcatcttgaattgaatttattaaatgaaaacttttttttttttggattcggtctattgccatgtgtaaaataagaacaaaatttaaagtgatttagaattgtgtaaaatagattttaaactacatttttacatcattagaaaagataaaataattacaacacttgtttcaattaaatatttcaaacactatatagtgatgatttacactttactgtacgttttcccataaagacttaaatttgttttacattctgaaatttgttgtgtgaattagctattggtagacatttttatttatacctactttcattcagtgagaaaaaaagcaactagaaaactttttaaaaatttcaggttagacaaatatacatcttaattcccatttctctttttttattagttattttagcatgattatgttgcttcaatattgaggcaaactccatctaggctcacctgccctgtcttcggtacactgatagccctatttccaagttttccaagttaagtgtggtcatgtgagtaaattccgtctaaaaaatacgtgaatggaaataatgtgtgccacttctgaacctactcctggctatgttccataacactctcctctgcctattagacagaggcaaccttaatgtggcagtgacccaaaactcatacaggtaaagggaaggcactaaaaaatggcgagagaatgtgaagaaaggaacctgggtttttgagtgaatgaaaatgaaataggctgcatgaaataaggcagcctattaatccagactgctcactttagaccatcaaatgagagggaaataaatttgtgtcttctttaagctgcttaattatgctaattttctttattacagcagcgtagcctaaataatgcacaccgatgaggccaggttcaataggataagaacgctttctcaaattcacaggttcaagttaatccatttatgcctgggtcatattcttccccataatgacatcacttatactgataggatctttttcactctccctagctgttttatcactgagactatatttggctgtacctctaatcaatgcttaatttgtttgagtttttttttttttttcactataagtggggctggggatgatgtctattttcaggatgaccaggagggcaatatgtatattgcaattttgcaagaaacatttaattcgacttgtttggtttccttgtgtgttcttggcctattcttgtgatgaaaataatccagaatattatgtagtatacttgttttctctgttttatttttctatctctggtgattcacattgattctgatgaaaacaccaacctaatgacttgatgcttttttatatataccagtgaatagtgtgtatttttctatatgtatttatattacatattggtatgatttgtctctgtgtcaccacccaaatctcatctcaaattgttatccccacaagtcaaaggacggacctggtgggaggtgattggatcatgagggtggtttcccccatgctattctcctcacagtgagtgagttattttgagagctgacggttttaaagtgtagcacttctcctttagccttctctctctctctctctccctctcctgctgccatgcaagttgtgctttgctttccccttgacttccacatgattgtaagtttcctgaagcctccctagccgtgtggaactgtgagtcaattaaacctcttttgtttataaattatgtagtctcaggtagttcttcatagcagtgtgaaaacaaactaatacaaaaaattggtaccaggagtttgggagactgctataaagatacctgaaaagtggaagcaactttggaactgggtaatggacagaggttagaatagtttggaggactcagaggaagacatgaaaatgtgcaaatgtttggaacttcctagagacttgaacggttttggccaaaattctgatagtgatgtggacagtgaagtgcaggctgaggtggtctcagatggaaatgaggaacttattgggaaatggagcaaaggtcactcttgctatgctttagcaaagagactggtagtattttgcctctgctgtggagatctgtagaactttgaccttgagagagatgatttagggtatctggcagaagaacttcctaaacagcaaatgattcaacatgtaacctatttctgaaagcatacaatcatatgcattcacaaggagatgatctgaaattagaacttatgtttaaaagtgaagcagagcataaaagtttggaaaatttgcagcttgaccatgtggtagaaaagaaatacccattttcagatgtgagggcaatctggcatacaggttttgctgatggaaaaggtgggttcccatggtcttgggcagctccacctctggggctttacagggtatagcctccctcctgtctgccttcacaggctggcattgagtgtctgtggtttttccaggcacacagtgtaagctgccagtggatctaccattctggggcctggaggacagtggctcacttctcacagctccactaggcggtgccccagtagggactctctttgggagctccaatcccacatttcccttccacactgtcctagcagatattctccatgaaagcccactcctgcagcaaacttttgcctgggcatcaggtgtttccatacatcttctgaaatctaggcagaggttcccaaacctcaattcttgactgttgtgcacccacaggctcaacaccacgtggaagctgccaacacttgaggcttcctccctctgaagccacagtccaagctctatgttggcccctttcagctatgactggagcagctggtacatggggtaccaattccccaggctgcacacagcacagggaccatagacctggcccacaaaaccactttttccttctggacctccatgcctgtgatggaaggggctgccgtgaagctctctgacatggcctggagatattttcccctacggtcttggggattaacattaggcttcttgctacttatgcaaatttctgtaactggcttaaatttctcctcaaaaaatgggttttactttcctactgcatcgtcaggctgcaaattttctgaacttctatgctctgtttctcttttaaaacggaaagcttttaacaggacccaagtcacctcttgaatgctttgctgcttagaaatttcttccaccagataccctaaatcatctctcttaaattctaagttccacaaatctttaggacaggggcaaaatgccaccagccatcttgctaaaacataacaagagtcacttttgctccagttcccaacaagttcttcatctccatctgagaccacctcagcctggaccttattatccatgttgctatcagtattttgggcaaagtcattcaacaagcctctaggaagtttcaaactttcccacattttcctgtcttcttgtgagccctccaaactgttccaacctctgcctgttaccaattccaaagctgcttccacatttttgggtatcttttcagcaacaacccactcctggtaccaatttactgtgttagttcattttcacattgccgataaagacgttcctgaaacagggaacaaaaagaggtttaactggacttacggttccacatggctggggaagcctcagaatcatggtgggaggcgaaaggcacttcttacatgatggtgacaagagaaaaatgaggaagaagcaaaagcggaaacccctgataaacccccagatctcgtgagacttattcactatcacaagaatagcataggaaaaacccacccctatgattcagttaccttgccctgggtacctcccacagaatgtgggaattctgggagatacaattcaagttgagtatggggggcggtggggacacagccaaaccatatcaagaaacattaagaaaagaaggccgggcgcagtggctcatgcctgtaatcccagcactttgggaggctgaggcgggcagatcacaaggtcaggagttgagactatcctggctaacacggtggaaccccgtttccactaaaaaatacaaaaaaattagccaggcatggtggtgggctcctgtagtcccagctacttaggaggctgaggcacaagaattgcttgaacctgggaggcagagcttgcagtgagccgagatcgtgccgctgcactccagcctgggcgacagagcgagactccatttcaaagaaaaaaaaaaagagaaagaaaaacagtttaggctgggtgcagtggctcatacctgtaatcccagcactttgggaggctgaagtgggcagatcacgaggtcaagagatcaagaccatcctggccaacataatgaaacctcatctctactaaaaatacagaaattagctgggcatggtggcatgtgcctgtagttcctgctactcgggaggctgaggcaggagaatcgtttgaaccagggaagcagaggttgcagtgagcagagattgtgccattgcactccagcctgggcgacagagcgagactctgtctcaaaataatagtaataataataataataataatgaagaaaagaaaaacagttaaaaaatctaagatgtcaaatattttaagaagtgaaacaaggtattttgtgttctttcaatatctttattaagaagtgacaagaagaatttattggaattgttctgtcagtagcagtggctaatatttataaatgcagctatattaggttaattaggctgctgtaacaagatagcatatgctgggtggcttgaccaacagaacattttcaaaaagatacctattataaacactgctaacctttagaaaagaaaaagaagttaaatgaatgaagtcagttgtgaaactaccttactgaaaacatgtgaataataagaaaatgatttattctactcagtctatggaaaatgtctttctctaatcataaaaatagcataaaaagcagaataaataaaagaaaagtcacacattcaaggtaaattagcagcattaaatggcagaaatttatttttttcacagttttagagaagtctgggatcaatgattggcaggattggtttcactctgaggtttctttccttgtcttgcagatggctgccttctcactgtgtcctgacatgttcatcttgtgtgtctgtgttgtctgtgccctaatctccttttcttataatgacaccagtcatattggatcagagttcaccttaaggactccattttaatttaattactattttaaatatagttactttgtattagcccattctcacattgctaataaagacatacccaagactaggcaatttataaaggaaagaggtttaattgactcacatttggaagttccaaaccttctcacatcttcatgatggatagggaggccttgggaaactcacaatcatggtggaaagggaagcaaacatgtccttcttcacatggcagcagtaaggagaagtgctgagcaaaagggggaaaagcctcattagaaccatcagatctcatgggaactcattcactatcatgagaacagcatgagggtaactgcccctataaataaattacttcccaccagattcctcccatgacacatgaggattatgggaactacaattcaggatgagatttgggtggcgacacaaccaaaccatatcattccacccctgaccactcccaaatctcatgccctcacattacaaaacacaatcatgcccttccaacagttccccaaagtcttaactcattccagtattaactcaaaagtccaagtccaaagtctcatctgcaacaaagtgagtcccttctacctatgaacctgtaaaaccaaaagcaagttagttacttcttagatacaatggtggtacaggcagtgggtcaatacacgcatcccaaagaaagacattggccaaaacaaagggatcacagggtccatgcaagtccaaaatccagcggggcagccaaaccttaaagctttgcgatgttctcctttgactccatgtttcgcatcctggtcatgctgatgcaagaggtaggctcccatggcctttttcagctccatccctattgcttttcaggatacagcctgcctcctggctgctttcactggctggtgttgagtgtctgtggcttttccaggtgcaaggtgaaagcctttggtggatctaccattctgggatctgaaggatggtggctctcttctcatagctctactaggtagtgccctggtggggactctgtgttggtactctgaccagatttctgttctgattcgccctagcagaggctcatcaggactcctccactcagaagacttctatctggacatccaggcattttcatacatcttctgaagtctaggtgtaagttcccaaacctcaattcttgtcttctatgtgtctgcaggaccaacaccacatggaagctgccaagggttagggcttgcaccctctgaagcaacggcctgagctctaccttggccccttttagatatggctggagcagctgggacacagggcaccaagtcccaaggctacacatagcaggggggccctggacttgtcctggaaaaccatttttccctcctaggcctccaggcctgtgatgggaggggctgctgtgaagctctctgacatgccctggaaacatcttccccattgtcttggtgactaacatttggctcctcattacttatgcaaatttctgcagctggcttgaatttctccccagatattgggtttttcttttcctttgcatcatcgggctgaaaatttttctaatttttatatctgcttcctgttgaatgctttgccacttagaaatttcttccactagataccctagataatctctctcaacatcgcagttccacagatctctagggcaagggcaaaatgctgccagtctcttttcatagtaagagtaacctttattccggttcctccaaagttcctcatctccatctgagaccacctcaacccagagtttattgtccatatgactatcagcattttggtcaaaggcattcaaaaaggtctctagggagttccaaaccttcccacgtcttccttacttctgagccttccaagtctctaggaagttccaagctttctcacattttcctgtcttcttcagagccctccaaactgttccagcttcttcctgttactcagttctgaagtaatttccacattttttgggtctctttatagcagcaccccattcctgtcaccaaaatctgtattagagttttctagagggacagaactaatgagatatatgtatttatgaaagggaatttactaaggagtattgactcacatgatcacaaggcaaagtctcacaatacaccatctgtaagctgtggagcagggaagccagtctgagtcctaaaacctcaaaggctgggaagctgaaagtgcagccttcagtctgtggccaaaggcctaagagcccttggcaaaccagtggaataagtccaagggtctaaaagctgaagaacttggagtctgatcttccaggccaggaagcatccagcatgggagagagatgaaggctggaagactcagcaagtcagctcttccatcttctctgcctgctttattctagccatgctagcagctgattggatggtgcccacccacactgacccacccacattgagggtgagtctgcctctctcagcccactgactcaaatgttaatctcctttggcaacatcctcacagacacacccaggactaatactttgcatctttcggtgcaatcaagctgacactcaatattaaccatcacacactttctggggccctgggagttagaacttcatcatatgaattttgaagggatacagttctcccacaacagtagccagcatttaataaatgctaactatgagtcttcattatcctaaacatttttcatgtgctgacttgtttaatctgtgaaacaaactgatgagctagatactattagaaattccattttacagatgtgaaaactgaggcacagagatggtaaacaatgttctagaagtcacaaaggtagttagtggcagagtggggtataaatggaggtagcctgccccagatctgccttctcagccactgtggtgttatgttagttggacaaataaagcacgaatatattgagagtgaactcacagctcagaagatgacttcatgctttgactccaccaactatgccttttggaaagccatctgatctctttggggcatccatagcctcctttatttgtgaggaaaaactgacaagatgatgaaaagctcttatgcaaataagaaatacaatataaatgtcaacagttgtggtaatttaatcagtaggagtgttcgtcacttatatttatggcagcctagctactcagctgagataggactgtgttgagaaaatagatctacggcaatatggatgaaagaagatcatattgtgtgtggcagtaaacctttttggctcctctagtaaattccacatagtactaaacagtctctagccttgtacatgtgtatattataattttacaattaagtgaaagggttattattttaaaacgattcaaaggtgaaaaagaaccaggaactgttgtgccaaagctctagcctctccagtgtcatttgaagctggcctggcattcatagctgttgttcacctattagatgtaagaaatctcatcaaacaccagcatcaaagtcactctgagactgtcccaaagcaagacaaaacaaggccacttaatttttttaaaaacacagcaaaaacaaggtcactgtgctatctgcaaaacggcaaacatccccctttcatgactaacatgagtgacttctacttctttaccaattacagctttagcctcattcttgtctgccttacatatagatgatacttactgagatatcagaacacagaattgccccctgctttttgtcagcacttagagtgaactcctgcttatttagattctcctcaaaagcacccaaccaaagcacaaaccctatagtagatttttttttcctaacattctctatattagtttgctagggctgctgtaacagagtaccacagactgggtggtttaaatgatggaaatttattttctcacaattctggaggctagaagtccaagaacattaagtgtcagcaggtttgatttcttctgaagcctctctgtttgtcctgtagatagctgccttcttgctgtgtccacatacggtcttttctctgtataaaaatatcaatctttcaatgtgttaacatttcttattattaaaaagctagtcggattggaatagagcccatcttaatggtttcattttaacttaatacctgtaaaggccttatctgcagatgtaatcacattgtgaggtgctatggtcagggcttcaacatatgaattttgagaaaacatgattcagcctatgaaatgtcttactatgatgtcccacagtttcttatgtgtattcttccttactgtaataagtaataaactcaacttgttcaactgcaggtatgtttctggtggtctttaactgaagggcattgacaaaagtactgcaattgcccaactaaaatctagcttttagttactagcattactagtattactagtatttaaagtactattttcccaagtgataaagacttataaagatctttttggttcataaagcttaggaagaaaggacatccaaaattgaaactatttcattacagactatttgaacatctccactttgcctttggctttacagataacgtaggcttgaggtaatgctccattcacatatatttctagtgtatccttatttttgtttgcataaaagtgggaggttgtgaatatcatgtatcccatcttgtcataaatagtgccacacatgattcagtacaatgttctagttttatatattcttatgttcttcctacccacgtggagggaaaaaaaagaggtttatactggtgtgagctgcccaatttagttactaactgtccacccactgttcttttctttgcaccctatgcttattctgcagttcgaatgatcaaattaaatggtagacctaattaactgtaagaactttgtaagcttctaactaaaaaatctgctgcttctggctcactttcttttttcctcacagaaaaacttctttatacttacggcttattactgtctgataatttatacagtatttgcctacacacacacatacacattcaactaattttattctaacaccttaattcatgtgcccatattctgtggcttgaaatctccctgtggttgcatagcaacctccgcaagttgcgaacagcaaaatgacttgttgtggggtactaggagagagcgtttcaagtaacattgagccagcatttccataagtaacttttttttctcttatactttgatagaagcatgtttaaaggggaaaggttagaatctgagattaatcagagaaaaacaagtattagacaccaaagagaaatgtttagacaagttgataaagcaactggcttgatgggttcaaaggtttttgtcctttgttgaaatgtgagcttcaatctgtgacttaaattttaaatggtgtgagcaaagagatttatttttaacataatgagattaattcactaatatattgaagctaaagccaaactataaatgatgtcaggtgctggaggtaaagctgtttgagatacaaacactatttatttatgtttcataaaataattcagttctgttttccacgacagtcaacaattttttctggcttttgttttagacctctgatgtactaggggtagagaggtcaaaagtctcagtgccttaggaccttattctttctgaataaaatctgtagtcttcctatgggaggtccaaactggaggaatactttttttcctcttatttaagcaggttgctatttgtagaatttgtagtgttgacaactccaaccttaatatccattgtctgcctaatgcacctaattaaaatacatgcacacagagaaaatttcccatttatgatgtagcacactagggaatgtcttccaatactatacttttcatttggttgcattatagtgtgcgttttaaagtcattctctagtatcctattcttcccatatctattaaagtactttttttctgtctgagctgcttatgatcatctaagtagtttcagtgtgccaaaaagtagtggctacaataactattttcatccattctgaatttaggccctgttaattaaagttgtgatcagaaaatcattttagtagtaatggactactcctggtgttcggacactgcactctcaatgagatccacatttcgtattttgtatgcagaaatattcaagagaagtacttttgctgactctggatctgatgtctataataaccctaagatcaataccatataaagtcaatcatctagtggagggaaagcataactaatatttattgagcaccaaccatgtcagtgtctatttatatgctgttctcaatgtggacagcaataaggtgggtattactatatgacttttaagtaatgagataaccaagtctcaaagaaattaagaaaaattaatcatgcctcacatctaagaagtaacagacgtagcactcaaacctattcgtctgatctgtatactctttcctaccaccccactgtgagattcagggacctaacattcattgactactctttgtcaggcactggtgggagatttatatgtattatatgtataatatattctataaggtgctctggatccttcaaagacttctaatccatggcttctgaactcaaagaccttgtaacatatttaagaagattaattttatgaggcaacattaaagtaacagaaaagaagtggagataattgctgcaggagctgagagacttcactaatcctcaggttgtagcttggcattcaggaagcctatgttcattttctacttttctgcttttgtcacaaattgcaggagctctatatatttatgacgttttgaatattgagtgattgtggaacaactgggtatagcctagctctaccacttactacagtggattctaggcaaatcaactacttttttgtgcctaaatttctctgtatgtaaaatgtacacaataatagcacccagtttatgatattgctgtgatgattaaatgagatctaggaatgatgattaatgattaaatatgagtttagaaaactttaaatttttatcattatataaatgtttcaaaaatagatttcatgatcataaaagaagttaaagttaggttggtgttaacatggttagaactataataacaggatttgtgtttgcatgggatatgattgcacatgtactcataaaatcaatgaaatttactttagtgagtattgagcatttactatgtgcaggcatttggttagaaaaagcaaatgaaaaaagaagacaaaaatccttgtccttgtcaaagttatagtccatcagggagtagaggagacacgcaataaacaataaatgtagtgaataggtaaatattatatatatctgacatgcatgtgaaaagaataatcttaaagagttctgagcagaaggaagttattgtactttaaaaagtggtcacaaaagcaattgatagcgtcatgattgtcctaactttaaggtatcttttcataactgcttactttaacgttaattaatggttaagcacttttatactttgtttttgtaattcttacaactttgtaagataggtattttcagccttgctttttaggtgaggaaaagaaacttgcctatggtagagtgcctgtggtggtagagtgtggatatgaattcagcttcatctgactttacagccatgtttttaactactagggaattatgtctattcctgcctgagagctattttttttcccttggcagcaaagattattaggttcaggttacaggtgtatgatttgatacagtattcctttcttcttgtcattaatgctttctaggtattgttgaaactgatggcaaaaaatgttagtaaaggaaagtaagagaagacgtctaattcagtccatgatttcagaagcagagctgtattagaaatgtaaattttaaaaaataacccagaaaataggaactggttgaaagttataattggatgccctctctcaccactcctattcaacatagtgttggaagttctggccagggcaatcaggcaagagaaagaaataaagggtattcaattaggaaaagaggaagtcaagttgtccctgtctggagatgacatgattgtatatttagaaaaccccattgtctcagcccaaaatctccttaagctgataagcaacttcagcaaagtctcaagatacaaaatcgatgtgcaaaagtcacaaaaattcctatacaccaataacagacaaacagagagccaaatcatgagtgaactcccattcacagttgttcaaaaagaataaaatatctaggaatccaacttacaagggatgtgaaggacttcttcaaggagaactacaaaccactgctccatgaaataaaagaggatacaaacaaatggaagaacattccatgctcatggataggaagaatcaatattgtgaaaatggcaatactgcccaaggtaatttatagactcaatgccatccccatcaagctaccaatgactttcttcacagaattggaaaaaaaactactttaaagttcatatggaaccaaaaaagagcccatattgccaagacaatcctaagcaaaaagaacaaagctggaggcatcacgctacctgacttcaaactaaactacaaggctacagtaaccaaaacagcatggtactggtaccaaaacagatacagaccaacggaacagaacagagccctcagaaaaaataccacacatccacaaccatctgttctttgacaaacctgacaaaagcaagaaatagggaaaggattccctatttaataaatggtgctgggaaaactggctagccatacgtagaagctgaaactggatctcttcctttcaccttatataaaaattaattcaagatggattaaagacttaaatattagacctaaaaccataaaaccctagaagaaacctaggcaatacccttcaggacataggcatgggcaaatacgtcatgactaaaacaccaaaaacaatggcaacaaaagccagaatagacaaatgggatctaattaaactgaagagcttctgcacagcagaagaaactaccatcagagtgaacaggcaacctacagaatgggagaaaatttttgcagtctactcatctgacaaagggctaatatccaaaatctacaaagaacttaaacaaattgacaagaaaaaatcaagcaacctcatcaaagagtgggcaaaggatatgaacagacacttctcaaaagaagacatttatgcagccaacagtcacatgaaaaaatgctcatcatcactggtcatcagagaaatgcaaatcaaaaccacaacgagataccatctcacaccagttagaatggcaatcattaaaaagtcaggaaacaacaggtgctggagaggatatggagaaatagggaagcttttacacttttggtgggcgtgtaaattagttcaaccattgtggaagacagtgtgatgattccccgaggatctagaactagaaataccatttgacccacacatcccattacttggtatatacccaaaggcttataaatcatgctgctataaagacacatgcacatgtatgtttattgcagcactattcacaatagcaaagacttggaaccaacccaaatgtccatctatgatagactggattaagaaaatgtggcacatatataccatggaatactatgcagccataaagagggatgagttcatgtcctttgtagtgacatggatgcagctggaaaccatcattctgagcaaacttcacaaggacagaaaaccaaacaccgcatgttctcactcataggtgggtactgaacaatgagaacacttggacacagggcagggaacatcacacactggggcctgttgtggggtggggggctgggggagggatagcattaggagaaatacctaataaaaatgatgagttaatgggtgcagcaaaccaacaaggcacatgtatgtatatgtaagaaacttgcacgttgtgcacatgtaccctggaacttaaagtataataataataaaaaaaaggattcagaactagagaaatggccaaactaacaggaaattagaatgaggggaacatatctaaattgatccgacaaagtctgacagatgttgcagacgtttcagtttacaactggctgtttcaaaaacagccagttttaacctgttctacatatggtattatgcatgaaagtttcttcaggcatgctttattttaaatccatcaattaatgcagtcttctcgttcaattgttgtgtggaaaaaaatgaaaaatgtgcagacggaataagctaaggctggcaaaaggagaattaaaagaatatttctacatgtttttggtaatcacttttttttctttttttttgggacagagtctcgctcagtcgtccaggctggagtgcagtggtgccatcttgactcactgcaacctccacttgctgggttcaagcaattctcctgcctcagcctcctgagtaccaacaactgtcttaaaaagaaaacattacagataactttggaacccctgtgtattcttctacaaacctatttctttctcatcctttctctccttcactacttctccttcccctgaggtaatcaccccttcattacttctccctcccctgaagttttcctctagatgtccatcatcaacaggaatcttttttatattttacgatatatgttggtttccacaaaccataaattaaatttccaattttacctatgtacaggaattgatgtcctgaaaaagtatcctgacaaacgtctggaaagactggttaaaatataagaaacgtttctcaaacatgaagttaaactcatgagaaaggaaatcacaaaaaatgaggagggaattgagagccaaaatgataagggaccctgaggttgtagctctcctactattgctttttatgtatttaaagttatattattagggtaactatagtcaataataatttaattgtacattttaaaataaaagcatctgggtgcagtggctcacacctatgttcccagcactttgggaggctgaagcaggaggatcactcaagcccaggagttctcaagaccagcctgagcaacatagtgtgaccctgtctctacaaaaaaattaaaaaattagtagggtgtggtgacacatgcctgtagtcccagacacttgggatgttgaggtgggaggattgcttgagctcaggaagtcaaggctgcagtgagccatgatcatgccactacactccagcctgggtgacacagcaagaccttgtcttaagaaataaaaataaataaaagactataatttgattgtttgtaacacaaagcataaatacttgaggggatgggcaccccattttccattatgtgattattacacactgcatgcctgtatcaaagcatctcatttaccccataaatatatacgtctattatgtactcacaaaaattgaaaataattgtttcaaagttttgttattaggtacatacacacttatggtgaatctttccttttatcattcagtcattctttttgcctaataataatttcatatatttttccttttgttcataaattttatattgttttatgccaactttttttggaagaatagcttctattagtatttgacagtatttgctgtcttttaaaaaaatatccttttacctgcaattgtttggggtctatatgtttttggtatttagaaattatgttcattgtaattattgttaattttatttccaccacttttatgctatttttattatgtttgttttttccttgtgatgtagtccatcagattgatggaatttactttgtcttttattctctctaatcatttgtaaatgatgtattctgtttatattcatttaaatgttaccctttaaatttaacatatatagttaacaaaagtttaaagagatcggaatttctgctttcttacccaatatataattgacttagtacattttccttttaataacctccatcaagttttccatattattgtgatgaagtgttctgtaattccacctttatttatctacccaaattaatcgttattcttatttgcagtcatttcttgttttcttggtaattttttcagaatcatctaataagttagtaatcatctgttcagtttcatttcattttctatttttgctgtctattaaatttttattttctagaaaatatatttgggttttcccaaatctgcctgggtatttttttgtatttatttttatattcagagtttctcctccatccattaactacttagtcatttaaataaacttactattttgtataagattgttctattttctgaagtcttaggggtgtacctcctgtttgtagcatctgctgattttgcttttggcttccttatgtgctttctaattttaaattgctcatctactgtaggcaatcctctgttttctggatttagggtgcatcctataagaatgattttttgcatttccttctatcaagaatcttaaagatttaccagcctgcaggcaacattttatatacattttaagctttggaccaagcaggtggtgggaattcaaacacaaaacctgattaaagttaggcctatggtcacatttattggctgaatttcttttctcctccatcacagatccagactggaaagaatagataagctatcttttcttttctctcagtgagaaaagggaacatttttatagctcaccatttcatatgaaggtaccctgtttaagggcaccaggtttatgtttgggattgggtaatggtgtaagacttgaggcagttaattcatatagcttttagtaagatcaacagtgcactccaccaaaacatacgaccaacttggcatttacagttctggattttaatttactcttcgcttttgtctgtgaaattgtgttactttcttttgacctactatgtatttttaaaatgtttcttgtatttatccaatgtgcttagggtttttgtagtttgagagcttttagattttctaggtctccctatgcaagaaattaatctatattcatgggcaatacaaagtggatttaaaaagcagcagactgttattgtggtaataaggaaagtcctgtagtctcatagattttctatattttgtccatgctattctttctaaatcacaagtccaattatatcatagcataaaaccccttcagtgatttcccatgctcttgggataaattctaatttttaaaggatatctttcattgacttttattctcttgtccccactttatatccagttctcgccatgtgatttgtatgaagctagaatgacttccttaagttcttcaggtttatcattttgttttccaccccaaggctttttaatgtgctgatccttttgctttaaacagattagttcctacctctcaccttcaccacaactccgttgatgattgtctgtttttcaggtctcaatttaagtgtcacttcttctagagagtttttcttgtcaccatcccccatgtactcacccacccatcttcattatatactcctagagcacatgtacttcctttccttctctcatgtcactaaaatcacacctatttatactgctaatttaatgaatatttttgctatgctataaattccatgaaaatgtacaccaaaattattccttcaccattgattttctacatcttagcatgatggcacattactcatcaattaggaaatactgaatatttcaaattataattgctaatgataattattattattaatagctatcacttatgggctagtactgtacagaaattataggcattacagtattatagggaaagcttaattaggggttatttataagagccttttacaaatggaaaatgacctgtatcctgtaatgttaattagccagtctgggaggttatatattcagacctattatagcacatggagaacatttttactatggtggctactttgtttttatttttatggatacataatagttgtacatatttatggcaaatatgtaatattctgacaaaagcatacaatatgtagtgatcaaattgggatatccatcacctaaaacatttatcatttctttgtgttgggaacattccaaatccactcctatggttatgttaaaatatacaatagattattgttaactatagtcaccctattgtactatcaaactaaatcttatcccttctattgaactgtattttgtgctcattaaccagtcactcttcatccttccccctactactctccctaccctatggtaaccactgttagattcaccacctccaggagatcaatttttttagctcccacatatgagtgagaacatgcaatatttgtctttctgtgcttggcttatttcacttaacataatgtcctccagttccatacatgttgctgcaaataacaggatttcattcttttttatggctgaataatattccactgcgcatatttcaccgcattttaaaaatccattcattcactaatgaacacttaggttgattccatatcttggctattgtcaatagtgctgcaataaacatgggagttcagacatctattaaatatgctgatcttccttattttggataaagacgtgggattgctgaatcatatggtatttctatttttattttgggggggaactttcatactgtttccatattggctgcactgatatacattcccaccaaagtgtactagcattcccttctccaaatccttgccagaatttgttattctctttttgataatagccatttaactggggtaagatgatatcccattgtggtttttattttcatttctctgattagtcgtgttgagcatttttttcataaacctgttggccatttgtttgtcttcttttgagaaatgtctattcaaatcttttgcccattttaaaatcagattttttttttgctattgagttatgtttcttatatattctgattattaatcacttgtcagttgaatagtttgcaaatattttcacccattccataggttgtctctttactgtgtttcttttgctatacagaagctttttagctcgatgtaaacccatttgcccatttgtcaatttttgctttggttgcctgtgcttttgggatcttaactcaaaaaatctttccccagactgatgtcctaaagttttttcctaatgttttcttctagtagtttcagaatttcaggttttacatttaagtctttaatccattttgatttgatttatatatatatataaaatgagatatagggatctagttttattcttttgcatatgaatattcagttttctgagagcatttattggaaaaggtgtcctttccccagtgtatgttcttggcgcctttgtcaaatataagttggctgtaaatgcaagatttatttttgggttctctgttctgttctattggtctatgtgtttgcttcatgctgttttgattgctatagtatagtagttatatatactatataagtacttacctacttggaatttttcagggtagttcctttttccaggcatggacactacacctaaagcatattgagttcccagatggcaaatacaggtgaaaagaaatctaaacagcattttgaaatctagacaggctgtggcacagaaagagtgtattcctgggccttcctggaagggacgtacagacagaagtgcagtcacgaatgccaacaatgaaatctgtttatgggtacaaataggaggtcatgtaaatatcagcaaatcatctgggcaaatagaccagtttatactgctgctaggtgaggaagatgaggttcaaggtgggctgtatgataataaattcctcattcaaaaatagggcagaggccatttttagtgatttacagtgctagcacggtcaaatattgcttttaaattagatatctgtgttgtagttcagcctttcaggcttattgatgatcttcaagttgaaatatacaaagaacagcgattaccatccttgtcaccactttaatttcacaattatctggagttgttttcaactatgatggttgtttgcatttgttattttgtgacatatccccatccttctagtaaagaagtttaaatgtggttcttgaagtttaatcacccccatgaagtgagtagtttcactgagccccttcaagtattacatgcacaggaataacagccaaaattgattcatttctgggtctttaagacagccatgatcatttccatctcaaacacaaatatctgatgaagttttcaaaatgaatttatagattctgaagaatatattatggcaacaggaatcaataaaatgatggattcttttttaaaaggtgtgtgaaaaatactggatagtgaaaggattggcaaatagacccatgaggaaccagagatttttggaatcattggctaagttcattggtagtgtattactgtaacactacactattttttttttcaggaatgtttggactcccttaaaggagcagatataacactcaacactagggcattaaaactcatcttgctcaagtattacatacaaatgatactaacacaactagcccaggacagataggctgaaattgtctttttttttttttttttttttgagacagagtctcattctgttacccaggctggagtgcagtggcatgatctcagctcactgcgacctccacctcccaggttcaagtgattttcatgcctcaacctcccgagcatctgggaggtgcccactattacacgcgcctaatttttgtattttagtagacatggagtttcaccatgttggccagtctggtctcaaactcctgacctcaagtgatctactcacctcggcctcccaaagtgctgagattacagacatgagccactgcgcctggcctgaaatggtctcttgaattaggagtatgtggatattttacattgtcattcagggaccagaaaacttcttggcttggaagtctgtcagagtgtctgtgtgtgtgtgtgtgtgtgtgtgtgtgtgtggttgaatggagacaacaacccttggagaattgtgggtacctttttttagaccaaagttcgccgataggcattcaaatattccaatgtgtttctataaggtgtataattttgtttgcatataatgagccccaactcatacaagcttatataaaaaaaaattggaagaattcacaaacgtccaacctactgttgtgatgttatttgaatacaggcccacctcataaccctttccatgcaatttcctcattttgcaatgctctgaaacaagatcttacttctctgtgtcacttatttcctgttcaaacgttaccttcttagagaaacattccctggatagcttatttataacattccccttaacatgctttaattttcttcaaatatttttcactatctggcattatgttatttatttatttatatgcttactgattgtctcctcataagaaatgtctctgatgacaggacaatctttttatcatttttatatctaccattcctaatacctagtagactttcaataaatatttgttaaatgaataaatcaatgatatttacagatttactaattctaaaaattcatttaaattgttctctgatttgggatttttatatgcattatttttctttatatatcttgttatataaaatataatacttttgtttctttttaaaataattcctcgaaaagaattttatcattaaaaaggcactaacatggcctcattctgaacatattttcaagcactgttacattggagcttcagatgattttctagattgctgaattagaatataatattgtcaaatgcaatattggactattagattggtgcaaaagtaattgtggttttcgccattagtgtaatggcaaaagttaaataatggtaaaaaccgcaattacttttgcaccaacctgatactattgttaattatacatttacattcctgcccatagcaagaccacattttgctaaacagaagtgagagtataactcagtagtgaatatccttcaaaaaatgacattggagtctgcggtaaagtaagacttttttttcacccatggaatatgaaagatgagagtgctttttctttttcttcctcaattttatcatcctccttctccttgctgctcttattcctctttctccttctcctctttctttttctgttctccttcccatttcttcctttcttctcttctttctctaatccttttgtgaaaaaatcccactgggtggaagtatggagctagttttaccagaaaacagcaatagaaaataacagttaaaaatagtgttgctgtttcagcacaccagcatggcacatgtatacatatgtaactaacctgcacattgtgcacatgtaccctaaaacttaaagtataataataataaaataaaaaagagagaaaaacatagtattgctgtctcaagatatcaatgctactattcttagaaagttttttttttgtatttttagaacttctacaaattgaaaagagatgaaaaacagcatcaggcagtatatatatgtgacaggtgggcaagacttgtctagagagtactgttaatactttattttattttaaatgtgtagtttacaataaaaggtgaaaaaagtgctgtagaattaactgttttgatggcgtatttctttagcttatttattaatttcctagtcacataaattatacaatttcagcttttcctttatctggatttgtgaaaagtgatcatggattagggaaataagatatctcagataagttagaaactggatagtgctaaaataaaaaaatatgatatatggctttaagtttgtgccttaagcagacaatcatatttatctcagaaaaaaatcataaatgtgttacagagaagaggattatactgtcatttctattttcatatagtaaaatgcatcttaaaaaataatacaaatggcatagcaataaaatataaacttattatttgtgtaaatgtctattaactgggactcttgaatataattaagtgataatcaggcagatgtcagaatgcacatacagttttaaattatttttctaagaaagcaaatgcagatttcattcaataaattccagaggcaggtaccaccaagagaagcttgccagttgatattagttactgtgatggtgtgaatgtagacaaaccgtcttaatggtttcagaggtgggaataaacaccttaaatttgctatagatgtgaaaaacaagtcaccatttgctccgatttatttggtgtgatggaagagtaatttgctttaatcctttgcaacagcatctctaggctccaaaaaggggagataggggatcacagataagaagcatgcagaagagagctccaaactgcagccagaatgatctttgaaaatacaaaatgacgagttaatgggtgcagcacaccaacatggcacatgtatacatatgtaacaaacctgcacattgtgcacatgtaccttaaaacttaaagtataataataatagaatttaaaaaaaagaaaatacaaatttaataatgtcaccactttgaataaaactctttatcgccttttattgcttttaagttaaaaaccaaaatctttatcatgatttatataaagctttttggtctcaacacctctaccccttcttttccaggctctaatgctgcacttctttcattggcccaaatgatctatgtctccattagctcctcctgcttgctggaaaacagggaagatccctgttcactggcccacttaagaccattctttcctcagattttaagtcttacttcctcagggaactcttctctgtctggcctttcagaccatttcaggttccccgttacaagccctcaaggcatactgtgcattgcctttaatatatgattatttgattaatgtatttttatccaacttgactgcaagcttcacaagggcaggacggggtcagatgttggtcaccattgaattcacgctctaatattttgcctaagacaccattccctttctcatcccttcattacatcctattttcagatactgatttttgaggttctctttgtactgtcaacctctagccacatcagttcttccccttctgtatacaatcagagactgggtgtgtgcatcagaatctaagaggcactgtacctctaagaaaaaaagaagtggtatttgaaaggaattttggtagcaatgcatgcaaaaggctgtagtttttcatatactttcttagttcaacccatgagaaggcagggaaaagatgtaggagaagatcccatttcaaactgagaaaatcagagcatttgaaagcttgcaaaccacatttaggacagtgtgtgatattgactttcatgctgaatttatagtagttgctgatttttaagtaaatgcaaagagaatacatgttaagattggtataaaacagagaaactctttctccataattaatattcaatactttttcttggttcagtaataaggccaccatctgaaatcaaaatgagacccatgacagagtaatggtcccttaagtgtggggggaaaagtcttctggtttaattactagggccttcaattattattccttcagatgaaaatactttcctcatcaatttcttcaaagtctctaataaaagtaaatcgattataaatgctttttacctccaaatgtgagaactttatgcaatgagaagttatttcttttttcttttaacagcttgcaaactgcaggtaatcataactccttattggcaggtaagaaaataatacttgtattgtgaatacatgatatcaaggtacataggtgatttgttccatttggattgtctagcgtgtgtgtctgtgtgtgtgtgtgtatgggtgtgataggtaggtacatatgggcatttttctagtgagataatgcatagcttaccaaatgcctataaccttctcccttgcaaccacttcccctaccataccaataaccagacatagctttatctgaatagtcagggacagaaaactaagggaatccaataaacaaggggggaagacaaaaagaataattagaaagacagaaaagttgaaaatgctgtgcagtatggttacacattccctcccaaagtcattttcattactgcctatgaaatctgagatttagtctatattttctaacattgctatatttggatattgatacagtatgttttagtagaatgaaccaagaagcagttatataaactgagaaaataaggaggaagtacagctgtggactgacatcagggtgggaatagaaaaatgttctggacttagaaaaagctacagatggaataccaatgatggcttggacatgagatatagctcactgactaccaatttatgatgaaaaccacagctgtactgaaaagttactacagtgatgcaatatattatatatggatagcattttaaattttagaaaaaagtgagagtataatttcacataattgtctagagctatatttacatttcctaaaaatttattctaagcccatgaacaaaatgtgtgtgaatttaacagaaaattatatttgttgacattaaattttttccccttaaaaccagcaaagatcttgattctacttagggagaggtgaataaatagtttctgttttgcatatagacttaaatatatgtgtgaaaaataaggttgaaaggttcactttagttactgtaaaataaggattatttatagtaaagtttattaagtcttcaaacacattttgttgacacttgtcaatatttcttgatgtgaagattttatgaattgttctcaaaaataaggtccaatgcacttgtttaggattaggaagcagcggtggtaaaataaattacagctctaaggagatctcaaacatgaaattatggaaaatccagcattaggaggtaatagcttgagctaactccaaccccaaacatgaaattacagattaatagcggcaaattatattgataagacattaactggaaattcatttatcagtccaagtaagattgagatactagacaggtaaaagcaaagtaatcaaagtaattaaacatagtatggcagaaacgtcacgtgagcttgttgagaactcacaataaaattaccatatattacattatgctgtattagtccattttcatactgctgtgaagaaatatcagagactgggtaatttataaagaaaaagaggtttaattaactcacagttctacatggctgggaaggcctcataatcatggcggaaggcaaaggaggaggaaaggcacatcttatatggcaacaggcaagagaatgtgtgcaggcgaactgccctttataaaaccatcagatctcatgagatttattcactctcatgagaacagcacagggaatatacgcccccatgattcaattacctaccaatgtgtccctcccaccacatgtggggattatgggagctacaattcaagatgggatttgggtggggacacagccaaaccatatcatatgccttatgaggcttgagtacaagcaaaggaactaccaatattatattattgtatggtagcccagagcatgggctccagattctggatacttttatctggggcaggaaacttgtctactctgtgccaaggtttcagatttacagggttgccatgagtattaaatgatttgatatatttaaagaccatagcaaaaagcctagcacatagtagattccttcaaaatattatctgtactgttaccactgccaccactattagtatttataatccatggggaagatcaacgtctatgatgttgattcttgaccaaaaacaaggaggaattactgaaatagtaatttatgagcagctaggaaaggaataattggccaccaggagccaagatgaattcatttcaaatgaatcatgtcagtctaaattcatttggacagaaatactagactgataaaagacctcactcactaaacattaggcattttgtttctgaactttagtaagtcagtagaaaagctctttaatcttatacttgtgagaaagacagaaaaaagatatttgaatagttgtttagaaaaataattgcttagtaactttactcaaagagttctgattaatgaattaatgtaaacatgtaagagaatttctaactgttcatttaaggttctagcttctgttgtgccctgtggaatacattttatcaattacccaattaagaataataatagaaattttagaagatattatttatttctaaccaaagcgaatcctccccttctcctactaacaaaacacaaattttgttcagctattaactgtcttttgtgtagcatgtgttcaagggggaaaaacatcaactctagctccagagtcatgattgatttaagacaatccttgtgcccctataacgttttaccactggtaagtttagaaagagagaggagaacattctgacctttaaggaaagttaacgaggatgggaaagtttctgaaagacagaggaaaagaaaagtttattaaggtcttcaaacatttccataaagaagaaaatggttgaagaggcaaatatcatctatagaccatgaagggaaaaagtcaacctggtaagcatagcaggaaagggtagaaatacttcactcattcataatgtctttgaaccagtgaatataataagctggagctttcctaccttcagaagtgtgtgtaatgtaaaacttcctactactatggcagttgaggcagggttctttttttttttaacttgaaactcaaagtatttgaactaatgtatcctgagctgtgctacatgtcttaagctcagtctcctctttaaatacctcaataacgctatgaggtgagtagtatatttatctacacttcattgagaagtaaactgaggctcagagaggtgaagtggtttgcccaaatcatagtgctagtaaactgcagggttgagatatatgcatttagcatttgcatacttagttattataatatacaaactttccagttaatatgtagaaaaaaatggttataaaggttttagagggatagcaaatgtgttgaatggctaatgaagatcccgggaaatttgaaagctaggctgaggccaagagctgaagttactcttgctccatgggaattttgttaattggaccaacttgagtttcagatctgatggcctgatcacaaattgtgtgtggaaataaaagactgggaaacaataaaaagggtgtggggcagtgctaatgcagaaactctgaggccccaacgtaaatctgagacctcaaaggactacaatctcagaatttctaagtatgaactaaaagctaaacgtgttcctacccatcccctcatccctaggatattacaagaaaagtttctctggcacttagcgagcaggagaaaagaaaaaaattcgttaagaaattaccaccatatgtgagattttgaattgaactgtggtaaaaattcttatcacttgggtagtaaaaacaacaacaacaacaacaacccacaagccataaataatttaccatgcaaacactaacaacaagagcaacaacaaaacaggtgcagctatattactgttaggcaaaattggcttcagtgtataaaagatttctgagagatgcagacagtcacttcacatagataaatggttcaatgtctaaggaagatagaaaatttatgtaaatatggatacctactagcatagcctcaaatatatgaagggagaacattcagaattatagaaataaataaatacatcttcagttgtggtggcagattttagcatacttatttcattagttgatacaacaaggagatcaaaacgtaagtaaagtatgaacaatacaattagcattcttgacctaatgaactcagatactcaaggacatacatattttatgtatatatgtgtgtgtgtatgtgtgtgtgtatatatatatggcatatatggaaaactttaaaaatattgacaatgtttctcaaagaaagcttcaaaaatctaataacacttgaaattatataaaacatgttctcttaccaaaatgcatttaagttttgagaggttagaaagcagtaacagttcttatgttatgttcttatggagaaattctataagatgggaactcattaaacacagttatatataatccatggtttaaagaaggaatcatattggaaattagaagatatttttaacttcataatagtgaaaaaactaaatagatatttcagggtcatatagctaagcaatgattagatatttgtgtccttaaagatttatcttaaaggataattaatgccaaccatttgtctcaaaaatttagaaaagtatagcaaaataaaaccccaaaatgtatgaggaagaatataataaatgtaagagaaaaattaatgatctagaaaacagatatacaagagaaagtatcaaccaagccaaaactctgcattttggagggaaaagagaaataaaattgacaaacctctggcaggcttaattatgaaaaaaaggaggcataaaaaattcatataaagaatgtaaaaaggaacataactacaggtgctgcatatcgtaactagatagatggcattataattatgtcaataaattttaaaatatgaaaaaaagttcaaattccttggaaatgataacttactcaaactgaatcaaggcaaaacagaaaatgggaattctatattcctataaacataaaataaattgagtgatcaaaattttttcacaaaaaaacttcagatctggatggctttacttgtgacttttaccagataatccaacaagaaataattcttattttatgcaaactcttccagaggatagaaaaggaaatataaggaaatatgtatcctagttcatttgataaggcttatgtggtattgttaccaacataccaattttcagtagatactaaaagctttctcttgggctttggaacctggatgctgataatactaatcctattcaacattaaatacataatttatgtaaaattaacgacagttcagtaaaggttctggatacaaaattaataccaaacagtagattaatatacaatgctatatgagccacaaacagaaaatgaagctttagagcataacattcacagtagcaacaaaaaatgtcaatgcctaggaacaagtttaacaaaagtgtataagatctctatggacaaaatgatggcgtttttgaaggtcattaaaatatataaataaacagtaatgtattataatcatggattgggaaacttagttttaaaaagatgacatttctttccaaattgatctgtagttatggcacagttcccacggagatcactatagatttggtattgttgaatttacgaggttgattacaaaatttttatggaaatgcaaaaactaagacattcttgaaagaaaaacataattgttggtgaaagcattctaaaagatattaagactccttataaagctataaaatagttgctgtactggggcaggtttagagaaatagaccagtggaacagatctcagagtccagaaacagaaccaggcatatataacagaggtggcactgcaattaggtaagaaaaagatgggcttttaaattaatggtaatggcataattgaatattcaccaagaaattaatggatattgtaaactccttctcataccatgtacaaaagtgaagtgtaggtggattaaagttaagattttagaatatccaatcagataatgtctttatgatcttgggctgaagaaagatttcttcattaaaacaagaaaacccttaaagaaaaagtgttcaaatacattaaaattaataattttttttcatcaaaagaataaaaaaatagcagaagttgcagcacatataaccaataggttatccatatccttaatatgtagagatttctacaactcattgaagaaaatcaataggtttatacagatactttagaaaacaaaaaaaatccaaagggtgattgaacaaataaaaagctaatgcctctcatttattattaaagaaatacaaactaaattcatagctagatatccttacttagtcactagagggacatgtgaaatttaaaaataaatacaatttggtatgaatcagaagtacacatgttttaataaatattttgggaaagagtatgacattctctagtaaagctgaatatatgaaaaacatttattcctttcccaatatactctctagagaatctcctgcatgtgtgtaccaggagatagttataagaattagattttaaaattagacagttataagaattgagatagttaaaaacatcagattttaaaaataaccacaaatagaaagcaacataaatattcatccacaagaaaatggataaaaatttgtggtatactcatacaacggaatgtcacacatcactgataaaatatcatgataaacaaaagagccaagttgctaaataataaattattctaattatagaaagttaaaaaacaagaaaaacattgctaaaagcaataaataattgttataaatttacaatattgggtatctcaaggcaggagggaaatggatgttacagaggaagacataattccaggttttccaaaatgttgtcgatgtcctacttctctaccttgttaaatcaggtatttgttttataaatatagtttaaattatacaggtgtattttatgtaatttttaatgcatatctttaaaatctatattgagaaaaagactacaagtggtatttaaaatttctattaataaatatctgttatcttattgatgtatttcttacttgtgtctgaaggtgtgtgtttcaatgtttcaatatataagatgttaaaatacatttaactccgttaaagataattttacattttttaaatgatgcttagtttcattatttataaaatattaaggtgaaattttatatacatgcacacaaatacacaatagagtattatgcattacattaaaaacgatgttgcttacagagctttgtatacaaatatagaaagcagcaaggaaacttagaaatgttacatatctataatatcaacgtgatccaataagaactagtatttgaagtaaaaaaaataatgtgaaggacgcaatattcttagtcttacctagacttttcagtctatacttaaaatagtcacttacagagtaaagtaatgaatatattgaaaagatttgacattagaatatttaataaagaaatatggataaggtgcagtgtggatttcatgtagacataagagttgttttcaaatatttgaaggcccattatatggaattttgattattattgtcaaaatggccccaataataccaacagcaccaataaaaatatacataaattggacttcatcaaaattaaaaactcttgtgctgcaaatgataccatcaagaaagtaaaaacacaaccacagaatgagagataaaatattttcaaaccacatatgtgataaaagacttgtatccagagtatgtatatatgaaactcttacaattcaataattgaaaagtaacccataagctagttctatttttaattttttgagtcaccttcatactgttttccataatggctgtcctatttacatccccaccaacaatgtataagggttttctttcctcggtagtctcaggaacacttttatctattgactttttgatatatccatcccaacaggtgtgaagcgatagctcgttttggctttttttttttttttttttgcatttccctattgattagtgatgttgaaccccttttcatatacctgttggtcatttttgtgccttctttggaaaaatttctatttgggactttcgccaatttttaaactggattgttcatttttaaaaatattgaattgtgagatttccttatatattttatatattaatctcttgtcagatttatgctttgaaaatattttctctcaatctgtagactaccttttcattttattgttccccttgctgtaaataaactttttagttttatgtagaccctcttgtttacttttgcttttgttgcctgagctttggtgtgatatccaaaatatcattgccaaggctaatgtcaaggagctttccctctatgttttctttgtggagttttatggttttaggtttcttgtttaggtcatttatccatattgaatttttgtgtatggcataagataacatacgcaattgtccagtttcagtgttttgcacgtgtgtatctaattttcacaacacttattgaagacattatcctcccccactgtgttttcttagtgggcttgttagcaaataatccctctgttaagaacatatccaaggaagtgaaatcagaacctcatatagatatatctgtgtttccattttcattgcagcagcattattcacagtagcaaagatgtggaaacaacctaagtgcccactgacagacgaatggataaaaaatacacacacacacacacacacacaagcacagtggaatattattcagtttttaaaaaatagatatagtaatcccttgatatctgcaggggatttgttccagcatgccttggagatatcaaaatctgtggttgcttaagtcccttaaataaagtggcatagtatttgcatataatctgtgcacatcttcccatatactttaaatcatctctaggttgcttatagtacctaatacaatgtaaatgctacataaatagttgttatgctatattgttttttatttgtgttattttattaatttttatttatctatttaatatctattatctgtagtttattgaatctgcatatgcagaacccacagaaatggagaactgactctacttccatttttgacaacatggatgaagctagaggacattatgctaagtgaaataagcaatatacagaaagaaaaatattctatgacctttcttatatgcagaatcctacaatataaagttgaataaatagaaacagagagtagaactgtagttattatgagaggaagaaatggagatgtggatcaaaggctacaaatttgcagttaggaagaatgaatatgtctaggggcctaatgtacagtatgaagactgtagttaataatattctactgtatactgaaaaatctgctaagagagtatattttaggtgtttttacctcacagatgcacacacacacacacacacacacacacacacacacacacacacaccaggtaaatatagaaggtgatggatatgtacatttgtttgactgcagtaatcatttatgtgtatgtatctcaaaacatcatattgcatatctttaatatagacaacacaaatcaattttcaaaacaattaaataaaccaattaaaaaaagagcaaaagacccaagtatacatttcttcaaagatgacatacaaatggccaaaagcacatgaaaagaggatgaagactgtcaggcattagggaaatgcaaatcaaaaccaatgagatactaattcactcctaccagaatggctttaaaaaaaagatagataataagtgttgatgaacatgtggggaatttggaaccctcacacctattgctggtggcaatataaaatggcacagacgctttatgttttatggaaaacagtttggcagttcctcaaaatgttacaggtagacctaggtatggaatttcaagagaattgaaaacatacattcacaaaaaaaaactttgtatacaaatgtttgctacagaattttcaacgtagtgaaaagttgaaacaacttgatcaactgggacatagataaataaaatttggtatattcatccaatgaaatactattctgcaataaaaagaaatgaagtactgatgcattttataatgcagatgaatcttgaaaacatattctaagagaaagaagccagtcaaaaaagactacagattttgtaatttcatatatataaaatgttcagaataggaacatctatagagacagaaagtagctcagtggtttcctgagctggagagattggggcaaaaatgggagtgattgctaataggagggatgtttctttttggggtcatgaagatgttctaaaatggattgtggtgatagttgctcagttctgtgaatatacttaaaaagttagaattgtacactttaatggatgaactgtatggtatgtgaatattgatgaactgttaaaaaaatgacccctaagggataaattaggttcaacaaatagattgtacaggaagacttatttgcctcaatatatgggaaaaagctaggtatatgagtttttgatggaacaatctgacattgtacatggcgattttctccctaccacagatgtttaaacctaggtagggtacaataaatgttttaaatattttatgtgtggttggcagagatgatggtctgtttccttcttttccttttttttttctttttttttttgagacggagtctcgctctgtcgcacaggctggagtgcagtggcgcgatctcagctcactgcaagctccgcctcccaagttcttttgtatttttagtagagacagggtttcaccgtgttatccaggatggtcttgatcttctgacctcgtgatccacccccctcggcctcgcaaagttctgggattgcaggcttgagccaccgcgcccggccgacggtctaagtttccttcaaccttatagtttatagttatattaggagggacctagttttattttataattaatattgtatgaacaactcaattatttgtgtgataaagtaggacttaaatacataaaatagttaaatatatatggaatgattgtatagtatttggtaaattgcatcatgaattaaattgtcttttctaaaacatgaagatgacccattagtttcaagggatggtgacttatttccaggaagaaaaagaaatatgtcaattgcctaatgtcaaattaaaaagatgtaattcccaccctttctcttgacccatctctgtttccttggaaaagaagtaaatttcaaatttaagtgggaaaaatgtttagctttggaagaaaagaatgcctgattatatgcttccatgacccttctgatttaagaattattacggaaaaaacagtctcaaccaaagcctctgtgttctaggtttgtgaccttctgcaaatcactaactctttaaatcttaatttctttatcagcataatggggataataatagggcaaacttcactgggtgtttagaagaattaaattaaatgagataatccatgtacaccacataaaacagtagctagcttatggtaagggctctataaatgtttatttaaaagcccaaacaaaaacagatggcttctgtcatcagaatggataacatttaagcaaagtttcaggaaagaaaactggatttaatcaggagagctattatgggatttatttatattttatctcagcacactgctttactccttccagttgcacaacctgtcctctgactagaggtgtagagaaaggattgtcaaatgggaactttcagacatatataaacatgtcaccttacatatgccccttgggaccagagatgcatctgcttagtggactggcagaagacaatagggaatcatatgtaatatatacttatcataatgtattactggttttctgtgcacatatttggaacctcacaggtcactttagagattataattttgatataaatgatagactctgtcatttcattcttaatgcttaaaatacatccaagataaatctaacataaagtagtgaaaactttagtttcactgctgacactaaaaatataaaagtatgaataagtcatatcttggatgcatgtatatattaaattttatttttaaattcctccaacagccttttttcagactgatggagcaatcatacgctgagttttgaatttatagcttgggtgaaggtgaaggtgcagtgttttatattaagaggctagatcaataatgctttcactgatttttaacttgaaacaaaacgaagagtttttgagactaagataatgcttatcccagtaaagagttgtgatacctaaatgacatatttccattttctaaaaattttgatgtatttctaaaaatgagaacaggacacaataattctagaatagcaatatatctgtttccttctggttgtcttattttggctttcatttcccacttttttggatgtcatagatctagctgataatagacattgaaatatattgcacaatttcagtacagagaaggccaccaaaatttataagtgtcttgagggatgtctttcttgttataccttagtgtaaaagcaagcatgcatttcctcccacaatgaaaactgaattgtgtgaaagaaggaaacttccatctatagaatttctgtctttttctttatctccacattcaatactcaaattcaggttcttaggattgctcaccagctttctaactggttatctgtcttctcatctttttttctctctcccatcctttatgttaaaatcattacccctaaatcttccccactaacatatatgcacccattttcagagtgtgcctggtaaaatggcactaatcccataagaaaaagcagagggagaattttctcatttttgttaatttctgttgctaccaaaaccagaattaatttatttcttacatgaatcttttactaccaaaatactttccttaaatttagtatgtgtcatatgattttaccattttaaaaatgcatgtgttggttcatattgttaaattgggtgctctctgaggcttgggactgtatttttttttctatagtcaacaaatctcccatgattttgtttctttgtagatgaattggggtagaggtagcagagatgaagagaagtaaacaattcctaatatatattaaaggcaaaattttggggaaatgataaagagtgaaatgtaactaatggaagaaataaatcaacaaaacaaattctttgtttttggtgtggacaattggaactatttagcaagtgatatgattaggctttgtgtccccacccaaatctcatcttgaattttaatccctgtaatccccatgtgttgagggaaagacctggtggacggtgactggatgatggggtggtgtcccccatgctgttctcataatagagaataagttctctcaagatctgatggttgtataagtgtctgacagttcctccttctcacactcactctctcttacctgccaccatgtaagacatgcctcttccccttctgccattattataagtttcctgaggcctccctagccatgcagaactgtgagtcaattaaacctcttttcattataaactacccagtcttgggcagttctttatagcagtgtgagaatggagtaataaaatgagatatggaaacataagggattctgtgcgtgtgtgtgtgtgtgtgtgtgtgtgtgtgtgatgaatcaagggtactgcttggagtatctcaagggagaagttaatcaaaaataaaatgtacatttgggagtcattaaaatggatttaatatttaagaaacattatgtgagaaaacattttgagtggtctattttcaaggcatgataaatctaagcaccggcagccagcctgcaaatgtaaaaaaccgcgtggctcatgcacctagaaggtcacaataagcgaacagaatttagaggaggggtcagcccataaaaggaagaatgttttgttattgggaaatcgaaacttaagtggggaagggaatggggtataaccttacaagggggataatggaatttaggcgatgtccgggaagattgtaactccatagtcgtcaaccagtgaggaactgggggagggacttgcatgctaagagataaatgagacctgttgtagactgcccgggatgtgcctgctcattagatacctgatcttgcaagaccgttattaaaaagcctcacttttgctgtttttagtgcctctggtccattctttgggtctggacacttgagcatgtttcccacaattggaatggctgagataaagtaggaagagagtagaaggaaaaaaaagttgtctagaaataatctttgaaatccttcaacattaagggccaggagcggtggctcacgcctgtaatcccagcactttgggaggctgaggtgggtggatcacctgaggtcaggagttcgagaagtccttcaacattaaaaaggtagagaagcaacaacaacaataaaaaagatcaaaaagagggagccaatgaaaggagaaaagccagaagtgtgatagatttattattgtgtccgctatacctctccctgtcttaaagagtattcatccctgcccattgccaggtaagttgcagagaatactttgacatctcactgactttgggctcagtcatgttatttggctaatggagaatctgcagacatgacgcacagcatatctgagcagatttagaagcactacaaatttctgccaaggtttttgttctggagccccctgccaaaagaagggtatgtcccagagagaagctgctcctttaacctgagaccctgtaagtatgaaaccagtgcataatttggagcaaagccatgccaagcaaggcacagaaactttgtaactaggcatgaggcacagaaaacatgtaattagagtcagaagtagttgttagttttcttaagtcaacaagactttgcagttgtttgtaatatagcaaaccccagcaaaagcagaataatacacaaagcaaagagagaatttcaaaaagtgggagtgaggctgggcggagtagctcatgccaaaaagctagtaatcctagcactttgggaggccaaggcgggtggatcacctgaggtcaggagttcgagaccagcctaaccaacatggcgaaaccccatctctactaaaaatacaaaaattagctgggcgtggtggcacctgcctgtactaccagctactctggaggctgaggtgggataattgcttgaacccaggaggtggaggttgcagtgagccgagatcgcaccactgcactccaatctgggcggcagagtgagactccatctcaaaaaaaaaaaaccgcaaaaacaaacaaataaaaaaacacagcaacaacaaataacctagcatccaaaacactgtgttctattaattctttgattttttttttttttgagacaaagtcttgctctgtcacccaggctggagtgcagtggcacaatctcagctcattgcaacctctgcctcccaagttcaagcgattctcctgcctcagcctcccaagtagctggaattacaggtgcacaccacctcgcctggctaatttttgtatttttagtagacacaaggtttcactatgttggccaggctggtctcgaactcctgacctaaggtgatccgcctgcctcagcatcccaaagtgttgggattacaggcatgagtcgctgtgcccagcctatatctgtttttaatagatgatctttctgaaaatactctcatggaaaattagcctcccccttacttaactagaaagcttaaaattcaaacactaatttctataatcacaaatcatcacatctacagcatttatttttaatttttaacatcctatgaaacagcaatttcccaggccatttaattttactaaattttacaggtatgtaattcttattaacttctgtatcttttctttaggctgggtacagtggctcacacctgtaatcccagcactttgggaggccgaggcgggtggatcacctaaggtcaggagtttgagaacagcctgaccaatatggtgaaaccctgtctctactaaaaatacaaaaattggcccgacatggtggcaggcaccaatactcccagctactcgggaggctgaggcaggagaatcgcttgaacccaggaggtggaggttgcagtgagccagcatctcacctctgcactccagcctgggcaacggagccagaaccatctcaaaaacaaaaacaaaaacaaaaaacaaaaaaaatacaaaaggggttggtcaaagatcagatggtggtagatgtgtggcattatttctgaggcctctgttctgttccattggtctatatatctgttttggtaccagtaccatgctgttttggttactgcagccttgtagtatagtttgaagtcaggtagcgagatgcctccagctttgttcttttctgttaggattgtcttggccatatgggctcttttttggttccagatttttctaattctgtgaagaaagtcaatggtagcttgatggggataacattgaatctataaattactttgggcagtatggccattttcacagtattgattcttcctatccatgagcatggaatgtttttccatttgtttgtgtcctctcttatttccttgagcagtcgtttgtagttttccttgaagaggtccttcacatcccttgtaaattgtattcctaggtattttattctctttgtagcaattgtgaatgggagttcactcatgatttggctgtttgtctgttattggtgtataggaatgattgtgatttttgcacattgattttgtaacctgagactttgctgaagttgcttatcagcttaaggagattttgagctgagacgatggggttagccatacgcagaaaactgaaactggatcccttccttacaccttaaacaaaaattaactcaagatggattaaagactttaaacataagacccaaaaccataaaaaccctagaagaaaacctcagcaataccattcaggacataggcatgggcaaagacttcatgactaaaacaccaaaagcaatggcaacaaaagccaaaattgacaaatgggatctaattcaactaaagagcttctccacagcaaaagaaagtatcagcagaatgaacaggcaacctatagaatgggagaaaattttgcagcctatccatatgacagagggataatatccagaatctacaaggaactttaacagatttacaagaaaaaaacaaccccatcaaaaagtgggcaaaggatatgaatagacacttctcaaaagacatttatttgggcaacgaacatatgaaaaaaaagctcgtcatcactggtcattacagaatgcaaatcaaaaccacaattagataccatctcatgccggttagaatggcgatcattaaacagtcaggaaacaactaatgatggagaggatgtggagaaatagaaacacttttacactgttggtgggagtgtaaattagttcaaccactgtggaagacagtgtggcaattcctcaaggatctagaaccagaaatactatttgacccagcaatcccattactgggtatacacccaaaatattataaatcattctagtataaagacacatgcacgtgtatgtttttgcaacagtattcacaatagcaaagacttggagccaacccaaatgcccatcaatgatagactggataaagaaaatgtggcacatatataccatggactactatgcagccataaaagggatgaggtcatgtcctttgcagggacatggatgaagctggaaaccatgattctcagcaaactaagacaggaccagaaaaccaaacaccgcatgttctccctcataagtgggaggtgaacaacgagaacacatggacacagggagggaaacatcatacactggggtctgttgggggttggggactagaggtgggatagcattaggagaaatacctaatgtagatgacgggttgatgggtgcagcaaagcaccatggcacgtgtagatccatgtgacaacctgcatgttcttcacatgtatcccagaacttaaagtataacaataaaaaaattaatttaaaaaaccccaaaaggcagaatggtcatttaagtcactctttcacagctgtgtgtaagataggtatagaaaggtgtccattagagttacgtcctgaaggttgttgtgaatttccagttcaaagctagggggtttaagagtaaacagaaagtgagaagtagacacagtaaatgtaaacatatttacagacagttttatggcagtgattctaacaaataaattggtagctggaggttcatatatgtcaataaatgtttgtttgaagacaggaaacagcatatgtcctgaaagtaatgattaatgtaaagagaaattagtaatacaggagaaggagagaagacaacctaagaagcacagtttcaagaaagaaatcgtgtgcttcaaggcctaggttaaagaattggcttttgataaaagaagggaccctgtaacaacgggagagaaagtcaaagtaatggtgcaggtaggcatgtagattaggtgatggaaagatggggaagttattgtctgaaggctatttttttctgaaagaggtataaagtgaatttattcagagtaggctaattaaaggaatgtagaggatctgaggagacaaaagcacaaaattgctatttccagagtgaggaagcaaacttgctagggaaagagggtttgaagcttgagcagctttgaaaatttctttgaggtctaggatcatgaaatttaaagtgaaactagtcatcccaggtacatgtcatttgcaagcaacttttggcttcttgagtatatttggcctcaaccagacttggagttttgctacacatgtatgtcagcaggagagaagaatgaagagtagaggatatcttccaggggagcctgtaatcatagaacaggaaatataagcttaatgaggaatgaaaggaagagagaatgaggaatagaacacagaattgaagaggagtgaaagaattgaaggtcttgatgaataattaatgcctgggtatgtagacataggctgctggacattaaatgaataattagtaatgaaggggaactactgctataccggaagttgatggtgttagacaagaaatatcatgaggccaggtaatgttttcttggacaccaagtaggatgtgactcattgtgataaaacactgttttgttttgttttgagatggagtttcgctcttgtcgctcaggctggagtgcaatggtgccatctctgctccctgtaacctccacctcccagattcaagcgattctcctgccttagcctcccaagtagctgtgattacaggcatgcaccaccacacctggctaattttgtatttttagtagagacggggttttaccatgttggtcaggcttgtcttggattcctgacctcaggtgatctgcccgccttggcctcccaaagtactgggattacaagcatgagccaccgcacccagcaaaacacttttttcttttttttccttaaatctctattccattgccaaagtgtagagaatactggtagtggcaggaggaattcagcttccagaaaaaagtacagagacagagtatttcagattaaagaaaaagtgtactgtacatttacaaaagaagccaaacgtaattttggaaatcatattgaaggggatcaagaactttatttgatttcacctgaaaaaagacttagtacctgaagttggtactttgagcatttatgcaatcaaattctaaggggaaatctgcagaaaagacatgactaaattgctacaactttgtaaagagtgataagaatatcttcaaaaaatgttgcttagctcaaattttataatttctcaaaaataaatgagtatgaatgagagaatggaatatagagaaacactttctgaaaaccttgaaccattatatattaatttttaaaaagccaataatcagaagccagctgaacccacaaacacaaaaatgaacttttggaatctaatttatatgatactttcctctttttctctcctgtaagtactatcagagtggcctcctcttcctctcatgactaatctcaagatcgaagttaaatagaaagcaacttcccaagatgcactattataaaactgagatatttaacatccccattgatatttctgtaatttatttttgtacttttttggttttagcaaatgtaaaattattttatgcattttataagtctactcatgatcttatttctcttaacattacttttctctataggccttggattcctcaaccatgatctcttctattaagattttcaaaaattaacgctaatatattttcaaaagtcatatttggtattggagccacagttactgttcacatttgtgtaggggaggaatgaggatacaagctaggtaaaatacaatgtacacacttaagtttgaatttcagataaacaacaaataatttttgtgtaagtattttccaggcaacatttaagattcaaattttatctgaaatccaaattaaactgcatgtctatatttttatttgcaaactgtgaaaaccttcaataggagagactgtcagcaacttattccttttattcattatcccaggactaccttaggttatatgactaggacaccccaaagctactaaatgttaaggaatgagcattatggtcatttcaggaatagactgacacactactaaaggaccaacaaaagaaaaatttcagagaaggggctagatcaacgggttgtagcatgtgaagagcctggtctctgatgtcagttagacctggatgagaatcactactccgaatcctactctctttgcatccctaggcatattccagttcctctgagtcattctcatcaccatgtaaaatggcaacaataataattacttttattttttattggatgaaatatagtaatatatataaaaatgcttaggacagtgcctggcacaatgtgtatcactggctgttacccagtgatggcattcaaatgacaacttgacaaattcctcatgagatggaaacagaacagcaatatgttccccaagaatcaaaaagttagttgtcaatgctgtttgtatagtatatttcttttaaaaatacatcatatttcagatttgaaatcacagctacatgtaaccattactgtctttaataatattctttcaggtacaaaggatggtaaataaatatatcatttatgtgtatacgtgtatcatatatgtcatatatgtatctatatatgtatatagtcacaaagctatgttttagaacaaataaaattcagtaaatttgtaatatatgaattctttacatttatattttaatgtcatctttattagactcatagctatcaacttgataagaaactcatagtgtatctaaatgatgctaactggacgtggaaaggtaataaattgggcccaacctaatttcttctatagaagtttactattgttgatgtttatataatctcaaaaaagattaaaaagggacttgattatgtaaaccctaagcatggatcaagtttattcaggtaattaaactaaagagcttctgtacagcaaaagaaactatcagcagagtaaacaggcaacctatggaatgggagaaaatatttgcaaactatgcatcaaacaaaggtttaatatccagaatctataaggaacttaatttagcaggaaaaaagcaaacagcactgttaaaaagtaggcaaaaagggcatgaacagatacttttcaaaagagatgcatgcagccaagaagcttatgaaaaaatgctcaacatcactaatcactaaagaaatgcaaatcaagaccacaataacataccatttcacagcagtcaatatggctattattaaaaagtcaaaaaattacagatattggcaaggttgcagagaaaaagaaacacttatatactcctgatgtgaatgcaaattagttcagccactaaggaaagcagtttggagatttctcaaagaaattaaaacagagttaccattcgacccagcaagcctattactgggtatgtaccaaaggaatataaatcattctaccaaaaaaacacatgtatgttccctgcagcactattcataatagcaaagacatgatgatatcaacctaaatgtccatcagtgatagactagataaaatatggcacatatacatcatggaatactatgcagccgtaaaaaaatgaaatcatgtcctttgtagcagcatatatgcaaccagatgccattatactgggaaaattaatgcagaaacagaaaaccaaacaccacatgttctcatttataaacgtgagctaaatgatgagaacacatggacacaaagagggaaacagtagacaccagggcctacttgagggtggagggtgagaggaaggtaagggttgaaaaactacctattgggttctgtgcaactacctgggtgatgaagtgatttgtacaccaaaccccagcaacacttaatttacccatgtaacaaacctgtgtatatgccccttatacacaaaataaaagttgtaaaagaaaaaaaaatgaataaaataataaagaggctagtgtatttagctagataagtgagagtcacacaaatgtttaaaatattattttgctcgtattctccttgtcataatttgattgaccttcacattatgttttgttgtcagcaacacaaatggataggctaaaatatactatatttgaagttatatgtaatacttaacatggctggattgaagaataatcttgctattgaagcagtattgatggaaaaactttagaaactaggagctgcattaacattttaaagaaaactattcaaattcctaaagtagtgtgcaatattagaaccactaatattgcactatattaatattcccactaatattccctaattaataagggaagaatgtcacttctctatcctgtaatattttggctgcatctcaaataatactgagcttttacattgtcatttgaaatgctaattcgtagctaattgttgtcattttacacttagttctatttggtattgtcagaggaattatttaaaagtattgaaattcaagatgcctggggattaaatagaggaactaataatttcaagactcagtaggattttgaaatttctggcagatattatttctaaaagatgcattgctttaattggagattttcattttaaatgattttatggcagattttgccctgcggtttataaattcttgaaggagaacaaaatcttctgttttcttggagaaaaaaaaaaaaacttaattgaattaatgaactattggattcctcaggttactttgttgtcatggtaacctaagttttcaaaaataaagaaaataagatgtgtcataggtttgagtttacttttattattaaaactttatcttccacagcacttaggaatccaatgttcttgtctttaatctagcatctaattccatagtatttctggtagacattttaatgagatttctgtttgcagacacacaaacagaaaaaaagagagaatatttgctcagactcgactaaaaatatatcaaagcagtgggagacaaaatatgcttttatcttgtatttcctaaaaattgtaacactgtcctatagtgctggttcctgaacagattatcctttaattttataataatcacatttttctagtgttgaaaggcacagttttctcaagtctttacatttgcttatctaggacccctagatacctaatggaagatcatgacagattattaaagggtgtttggctaagctaatctgaagaattaatttggttacaatgtttttatcatatttctttaatttttttcaattgtaaactttaacttcctttctgaattaaccaaaatgtcacctcttcatgaagatacatgtcatgaattattctacacaatgcctcacactaacaaagcattcaaaaatataaaatttatgaaaatatcttaaatattcaaaaccctcaagatctaatatttagtgataatgaacaataggtcaaactctgtgttaaatatccaggagtacattaatgaataaatcagttcctgctctcaagaagcttatgggccaggcgcggtggctcatacctgtaatcccagtactttgggaggccgaggcaggcggatcatgaggttaagacatggagaccatcctggccaatgtggtaaaaccctgtctctactaaaaagacaaaaattagctgggtatggtggcatgtgcctatagttccagctactcaggaggctgaggcaggagaattgcttgaatctgggaggcgggggttgcagtgagccaagatcacaccactgcactccagcctggtgacagagcaagactgtcaaaaaaaagaaaaaaaaaaagtttatggctaaaagggaaaaaaagacaattaaaagagccattaaaacactgtgattagtgatatagtattcaacctcaatgcatgatggaagatttcccagagggcacaatttataagctgagttctaaaatgtaatcaggagaaaaacaaatggtgctggtggaggggtgttggaaaaggaaataaagatctttggtgacaagctcgtaaggtgcattagaaacttgtttccacatgtatttagaatcaatatctttcttttttcttttttctttttcttttttttttttttgagatggagtctcactctgtcaccaggctggagtacagtggcacaatctcggctcactgcaacttttgcctcccgggttcaagcaattctcctgccacagcctgccgagtagctgggattacaggcatgaaccaccactcctggctaattttttgtgtttttagtacagacaggttttcaccgctttggccaggatggtctcgatctcctgccctcgtgatccacctgtgttggcctcccaaagtgctgggattagaggcatgagtcaccctgcttggctttaggttgtgatcagcttaaaataattggtataagatagtatttgcaagcctcatgttaacctcaaaccaaaaagcatacaatggatatacaaaaaatatgaagcaagaaactaaatcatactgccatagaaaacaactttcactaaaaggaagacaggaaggaaataaacaaagaagagaatgccacaaagcaatgagaaaacaaataataaaatggcgggagtaagtccttacttatcagtaataacattcaatgtaatggactaaagtctccaatcaaaagacatagagtggctgaatggatgaaaaccaagatctattgatttgttgcctacaagaaatacacttcacctataaagatgcacctacattgaaaatagagatggaagaagaaactccatgccaatagaaaccaaaaaagaccaggagtagctatatttatatcagtcaaaatagatttcaagacaaaaactataagaagagacaaagaagatcaccatataatgataaaaaagtcaattaattaaaaagatacaacaatttaaaatatatatggtatccaatactggagcacccagatataaaagcaaattttattagaggtaaagagagagatagattctaatacaattatagctggagtcatcaacgccccactttcagctttaaacatatctttcagacagaaaatcaacaaagaaacattggacttaatcagagaaatgcaaatcaaaactacaatgagacaacatctcactccagttaaaatggctcctatccaaaagacagacaataacaaatgctgatgagaatgtggagtaaaaggatcacttgtacactgttggtaggagtgcaaattagtacaaaacagtttggagcgtcctcataaaactaaaacagtttggagaaaaacagtttggacggtcctcataaaactaaaaatagagctaccaaacaattcagcaattatactgctggtacatacccaaaagaaagaaaacaagtagatcaaagagatatctgcactcccaggtttgttgcagctttgttcacaacaaccaagatttggaagcaatgtgtcttcattgacagaataatggataaagaaaatgtggtacttagacacaatggagtaaattcagccataaaaaaataagattcggttatttgcaacaacatggacggaactggagttcattatgttaagaaaaataagccagacacagaaatacaaatgtcacatgttctcacttatttgtgggatctaaatatcaaaacaatggaacccaaggagacagagaatagaaagatggtaacaagagggcttggaaaggtagttgtggggtgtggtgagacagaagtggagacggttaatagatacaaaaatagaatgaatgaataaggtctagtgtttgatagcacaacagggactagggtcaataataatttaattgtaacattttaaaataactaaaagaatataatttgattgtaacacaaagaataaatacttgaggagatggataccccattttccatatttgatgattatgcattacatacctgtataaaaatatcttatgtaccccataaatatatacactgaccatgtactcacaaaaatttaaaaaaaatttaaaaagtaaaatgagttggtcattcttagcaaaagaggagaaaagagggggtattggaagttttagaagtgaggcaaacaatgaacaatgacactgaagaatgagactttgatggccaaccaaatgaagtagtttatgttgagttctactaaatatcaccaaacaatctattaataaaggaaagcaaaatttactagaattttcttcattgggtagcacaccaccttaatatagtcttggtattgttttgggaaggagagttcagaagtggaatatttataggtcattgttatataagatgaagttgttgaagatgagtctggaaagatggggaactaattaggtttagacaaaattaatgatataatagtttagatttggtggacacagagaaacaagggtgatgaagcaagtcttgataaataaactatgggtgacaaacaagttattctctcaggtgaacagtctattgcctctaataaattgatctttggaaatttacataaacaaacaatgatttattggtttacatctttatttttttcttggcaaaatttcctggaacaaacaactaactcatgttgacacaggtaatatacaatctcaactaagtcatagtgacacacgttgtttcaattcttcacctctacatgtcatcattttccagcccaggctaaaggatagaccattatcatctggggaaatgatcagttcaggtctatataaattctttggaaagtcataattacacagcaagtttttgctggtagtcatttcaactgctatatatgtcaggttttcttgttctttttggcaggtcagttttttggattacttgatggagcagtggctgaacaacagcatttaaaccatgccacttagacaaatactagaataattataatcaagatttgtagctgactgctaaactgaaatccaacagtgcctaaattaaaccaagataacagattccatccccaatatgaagagcctgcagaacaaatatgaggctattagttaattaatttcatgatttcctcatttatttgtcatcttcttagtagtattaaaggtctcataaaaatctgtagggatgctataacaattattcctctgaaatagcacatgtgccacctcaattattcctctgaagtagcacatgtaccaccatgtcaatattctgtctaggactgctctattttaaatcaacatgttccaatctcataaacttcttatgagagcaaatctatgcgcttactgaggttgtttagcttctctttcaattattgaactatgacagataagaatttccttatattctatatctctttcaaagaataatataaaaagtcttgaggacagaaaaaagttgtctagaatttttcactgaataagttaggaattgaacctctaattgaggccagtttttcttttcttaaagcaagctatttttcaaagaaggagaactagagggtcaaaatggaaactgtgttattttagagactatcctgcagacagatataagtatcctgagataagatcttgtcaggttttctggtagtagccaataacctttttttcgtgtgtgggggggcacacaaattcaataatagtcattgatttctactaaatgatgtgatcttgactgaaatagcttaatggagtatctcgatttcattatatggtttcatttctattcagaagtagttaggtactaggcagaagaccataaagtgatgacattattaaatagattaatgattcaatctgataggaaatcagttttttaacttacataggaagccttctttgtaaggtctgtaaatgtaagaggtaaactataaaacatgtatttcctgtttttcatctgagcctaatccctataaaagtttgattatcaggtctatttattacaaatggatcttggctgttattttcgtgaaaacagaaacctcttcttgtaggtattgtacgacagatggttttacatttttgtttacctgaactattatgctatttgctagataaaactcatgttatggttcagtctaataattagtgtaaacaaatgtgttttaggcattaatacttaagagaactgattaacattcagagatatgtacaaatcagtcagtttgattgtacatttgtccaaatcatgaaaagtatgcagccagggattggacccataccaaagagtaattaagaatgcataaagacgtattatatataaaattttgtaagtattacattaaaaataacaagtgtttatttaaaatataaaaccttaactcagcaaaaaggaaagaaatcaactaggaaaacaaaaaacaaaggcatgcatggcaatctgcagccccagtgagctagatctagttctgtaggtttggggtggatgttttctacatcatgctgttgtcttcttgatctgaagctcttggtttgaagacgtcttcttctgactatctgcttctgaaacattcttaagaatccttatgttaaatctctcaatggaatggcagtacagtacaaaggaagtttgaaactttgtgtgatttttagcaagggcacatgaatccaaggatttacactatggagttaaactgctgtgttagtggttagaagtacctgacaccattgttcccaatgtagttccaagacattttttatcctttttcagaagataaagtctctgagttttatcacatagaatttgtttaggaggttgtgaaggaagagcaatttgtatatgttgttgataagattaagtatattgcacgagttcttcaaagaactttgctatgccttgatgtctgatggaagtaatttagagtccaaaattagaagagaaatatttaacctcttatggtgatatgtaataattttgatgatattttatgggtctcagaggtaaaggatttcatggttatgaggacattgttaggcaacaagccaaatagtgatagacaattttactcatttgaatttaagcatgacattgtctctttctactttcctgaggattgagagtgatctggaccataaagttgtttatgtggcaaagactttaaagttctataataacagtcccagggaaatgaatatttttatcactggagagataagttggaattccctgtgctaggtacataaaattagttaaacttttgctactgtctgagccatagctctttggtaggaacagcttcattttatcctgagaataatcactgatctggacatattaaaaactcattagaaactcaatatggaacctatttggagtttttcaaagggactgggaaacttgcgttcttgaccatgtcttactcttacagtttaccattattaaactggtgacagataagataggcatcagagacacactaaaaaatgtctgtaatattctcccttcctctaaccaagcattgactgagtacaaaggccaatctgtctttgatcttgtgagtaatatcatgtaaaattttacaaagttccacttgaaggtctctggtacacccaaggagttatattgaaagcgctaggagtgtcctcatgtactttgcatacagatttatctcaataaccctctgtcattaagcatatggtatatatctctatttttttgtttggtgagatatttttattttggaataaacagtatcagtagcaataaactaaaaaaaagaaagtgcatgtataatgaaatcttatggtctgtctctttctcaataaagttgataaagaatatttaagctatataaatatttgacaatatttatcatccatcacagaggccataatatatctctgaccatgtggaaacttgaaaatctaagtatcctgaaaaacataaatcatcatctgttccaaactttattagatacttgaagctccagaaggtaaatctagattaaaaattattattttgaattaattttgctcaattttaaccccaagctttttttcatgtacaaaaaatgaaatgttagatattaatgtatcagagcgattagcggaattttgcaggcagttaaatgatgctagttttcacataaacatcattagatgcttaaaataggaaatcagttaatttccataatgattcccttttaaaaaacttaatttcatggaatcaaagtaaatcttttggaagccgattctctcatagtttatatgtttaacattattatattgctattgtaaatttagttgacaagtttgaaactctatttaaaatggttattgcagtgatactgtagctaaaattttttgtgtagagaacagtattgtcattaaaagactgctataactaaattaagaaaacgacaaagtgaaaatttacttggtatttttacgatacacattaatttgccaaaatttgatgaatattttaaacgtgtacacacttagagtaacaactgcaagatgtctgtgacaaaattgatgttgagtacaactaaacacttcagcctgccaataagtttctttctctctttgctgtccagcattgttcagacttcagaaatgcttgagtctttgaagaactgccttgtcattcaacctaagtatcttactgtggtaacaaacttttttttttttttttttttttttgagacggagtttcactcctgttgcccaggctggaatgcaatggcatgatcttggctcactgcaacctctgcctcctgggttcaagcgattctcctgtctcagcctcctgagtagctgggattacacgcgcatgccaacatgcccggctaatttttgtatttttggtagagacagggtttcaacatattggtcaggctggtctcgaactcctgacctcaggtgatccacccgcctcggcctcccaaaacactgagattacaggtgtgagccactgagcccggccggtagcaaacttttaaataatgacttccctaaatcttggttacatttccctgaaaaatcaatgagaaatcttgaattaaatattcaacaagtggaatgccaagagtctccatcttttggagaataattgaaaataaatcttataaacagaattattgaaaataaagcttaaaagcaggattgtttggaaatttctcaatataaaagcaaaggaataaatgaacaatttaaatagtaggagttcaaacagcaagtaagatttagtttgaagttctagaattgctttcggaataagctgattttgatggaactcccattttcgtggactaatttagattctgtacaagaatagaatgaagcttgagaaggcctataattttgcaagatctaaatttggcaaaacatctaaaacaattataaatagcaatgagttacttgatcagttttttacgtaaaatatttttcagacaaattctctgactgcaggtaaaaaagatgtgcttgcaaaatatttgtgattactcatttaaatacaaaatattgaactaagaatgtccttcatttggtagaattcactttgggtttatcagttgttccatccctataaaaagaatattttcctaataaaaatcattgtgattacagaaaatattctattgatgatagcaacaatttcaaatttattcacattatatttggttttgaagaagactgcagaaaattttacaaaaaaataaatatatgaccattgaaatacagtatttggaaaaatgccagtgacatggttttgggatagatacaactaagaaactgattaaaagtacatgcatatgtaccaacaaggtttacactgcttattttattttttaatattctgatagccaagataaagtagatttccccctttttgtacatttttatatgttatttttactttctaagtagaattttattttaaaattagttttaaatgaaaatatataggtccaccagtataataaagccgaactttagcacataaatatttcaaatatttatattagtttaattattttagagacctatatttactgttggagttgcttcagttcagataataaataatgtggtctctctaactaatggtggtaaataataaggaaatgaaataagagatggaggcaggaggcaaaatatgaaactgaaggtgagggtaaggggttttgattctgtggaacagacagactagggaagagctacttctcttacaatttgaggtgcaggaaattgagctaagattgagtttacctatgcctggaatattctattaacacaataaggttctagtttgaacatgaaaataatgacgataattataatgttcttccaaactcttccaatacttttaattaatgagaagtttagtaagaataagctttttgtctgaaagcttactatgcatcatattttagttcattacagcattgcattgccagcaccttatcagtaaattaatcataatcccatacgattttgcagtctgataaagaacttacatatgtttacccacaacgtggtactcagacctgaattcagctgaccatcctcccttctttttctatttgttttattggacttaaggcatttgacaattccttttttttttttttttttttgagacagagtcttgctctgttgcccaggctagagtgcagtggtgtgatctcagctcactgcaacctccacctccaggttcaagcgattctcctgcctcagcctcccgagtagctgggaatacaggcatgtgtcaccatgcccagctaattttttgtatttttagtagagatggggtttcactgtgttcgcaggatggtttcgatctcctggcctcgtaatccacccgcctcgacctcccaaagtgctgggattataggcatgagccactgcgcccggccaacaattctttttccttatactgtcttagcataatccttctcactcaggtgtttgctgcttaatctgtatttggttttagaatggcctgggcataaatgtgacatttattcttatccagtaatttttcagccagccttttggcttaattttggctctactgttctatgagaaattttcaatatttaagcagcaaaacaacaatttcaataggtgaatttcaacttattgcttcttgtctcattttttacctttcttgccactgttaaatacattgggaatctcttttttccttccttattttcctaagtataggcagtcccagggtatcctgtagtaaaaataatttttatgactttcatatcctaggtttgtcttaagtggcttcatgttatattaaattattgatatgtaatattattgagcactgtctacattccagattattttctatgagttttacagttattaacacattttacagttattaactcatttttcaaataacactataaagtagatgctgtcatcatcctcattttacagataaggaaacagttaccacttgtttaagaaatttccccataggcacagatagtaaatgttcatgtcagaatttaagttcaggaactcttgtctagtatactatactgctttttacatttaattcaggtaaagaatggctaaaaaagaaagaatggagaattaacagaatgtagaaccaaatagggcagaagcagtaatcccagtgaaggagctaatcatcagttatttgatttaaataggtatgtgtcgattttagaacattttctggcaaataataaacattccagagaagtgtcaaaatggtgtagaactttggggatcaagtttctacaccgtgatggttttagaagcataatattggaaagatccccaacccaggataggtggtttcaaagctagaaggggaaaatggggacaggccagtccctaagcaatagggcttagagaaagaagaaaagagagcatgcatcattcagtaatctgaggtacctatcaggaccctcttttttcaaggtagaaataacctggaagacaagagtcaaggaaagctctgaaataacaaaggcccattcaggaggggctcaaataggtggcttcctctagaaacattccagtgaaactactacttattatctatgttcaatatttgttggtatagcaggaaacttccacatttttgttactgattgcaggctcatcataatcagctaggataaggctctgattgtgataattatgataatactaagaaaactttattatgcatgcaaaataatcatattccaggcatctcaagtgtctcaatattttgttaatgtaaaataatgtaaaattccaagaaaatagtaaatacccttaatagataatcatgcacatttattgcatatgctaaaaaccagattttccataaatgctgactctttatatatgaagttttcagtaaattgaatatgtatgataactaattgtacaaaaatttcatttctaaccttatagaatataaaccaattttaatctctttgaatatatttcagctcgtatatataatagaacaaatggaaaaaagtgagataaaggagtctcagaataaaaaaacaattttttccttaaaattcaattatgtaaaatgaatttgctttgcaacaagaaaatgttccacttttagcctgtaagagcttaacattttggcaataatagctgtggtgcacaaaataatactatttgagcaagatcaagagaagggacatcctcaagggatgtaaggttctaaattctttggaaattttagatgatttcataggcaaagtttattcattgactgtatgtcacatgttttcccattgtctgaggcaagtaatatatataatatttgtgttaaaatgggtttctttcgtatatatacatattatatctattgtataagatatataataggaagaatgttaattattaggctataaatattattacagcttctaaatacatatcattataatttaaagtctttcaagttttttgttgttgttatttttaaactaacgatatattttgggagccgactatcacttttaaaatacaatatgtagacagaaatatttttcttcaggtgaagtggccctaacaaaaatataaatctctgttcttggagattgaaataatgtgagataccatttttcacctattagattgcagaaactaaaactcttaatgataccctgtattggcagggatatactgggcgaaaattcactcttatatactgtttgtttgaaaacgattggattggtacaatttgttggagaggcttttgtcaacagactaatcacttaggaatgttttggctgcaagtaacagaaaatttgacaatgtggcttgaataaataagggtttttaaaaaatacttcaaacaatatgaagttaattgctggttcagcaggttgatgataaccagcaccacctcttctgtgatttcattagcctgcccctcatgcatgtcaccccatgggctccaaacagctgattcacacattttgttgactcacacatttttctctgttgccaaaaacaaagaaaaggagaaagggagaagggctatgccagcttttagaaaaagaaggagatctctagacatttcccctcaaaagacttttgctcatgtttcaagggtcagataaagtcctatggccattcctagatttaaaggagactgggaaagcaagaatttgatttcctgttgctctagtgggaggtgacaaaggagaagtaggttgaggatggctttacaatgaccaattaacagcatctataaaattataaaaactattttaagaaatacatttcctttgattcagcaatttcacattcacaaatgtattcttcagatatattttcaaggatatagtacaaaatgttcaatgaacgtttttctggttgtttggaattgtataaagctgaacatttgaagaaaattgataataattacttcaagatgcatcatttttgccccaacacacacactcatcaacagagcttgaaaacataaattgttcccctggctcttgctgtagatgggttttctctctcatccaagaaagagggctcaaaaagatttacttgtaataggagtgacagtaaaaattataggagaacaagatcatacttcatagcaggatgcttgctgagttgcaaaaatttgtaggcttatatttaagataggcctacaaaaataaattagagaattagaatctcttgaattgtggtgtttggagctcagtgtgaaaggtgtcataatgaaacaattgtttcatttatgctgggggaattctgaattatggaatctggctgattgtaatgaaaaaatacaatcctttctccttatgtttcaaggtaggaagcattaaactagatcttcatggtccaatatggtagccagtgacttgtacctctcatgagtgttttttttttcttttttcttttttttttttaattatactttaagttttagggtacgtgtgcacattgtgtaggttagttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgtgatctcattgttcaattcccacctatgagtgagaacatgcggtgtttggttttttgttcttgcgatagtttactgagaatgatgatttccaatttcacccatgtccctacaaaggacatgaactcatcattttttatggctgcatagtattccatggtgtatatgtgccacattttcttaatccggtctatcattgttggacatttgggttggttccaagtctttgctattgtgaataatgctgcaataaacatacatgtgcatgtgtctttatagcagcatgatttataatcctttgggtatatacccagtaatgggatggctgggtcaaatggtatttccagttctagatccctgatgaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgaacactttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccattttgtaggttgcctgttcactctgatggtagtttctttggctgtgcagaaactctttagttgagtgttttaaaatgtggccagtcctaatgaaatgtgctgaaaatgtcaaatgcacatcaaattttgaagacttagtacaaaacaagagtattagacatcattaatatttgtatactgattattctatgaaatagtaatattttgggatactgggttaaataaaaatgtattactaaagttaattttacttgtttctttttcctttttaatgtggttactagacaatttaaaactgtatatgtgactagcacttgttgttcatattgcatgtatagtaagacaaagctgaactagataacgttttgcttctctcttcatttctctcatttctttatttggaaagaggagaatttatctgatgagcctgcacaaagtttctgactacactaactactctttctccagtctttgggaaccag

SEQ ID NO: 16 - DNA, 6012 bp, Homo sapiens
caaagtctgagccccgctccgctgatgcctgtctgcagaatccgcaccaaccagcaccatgcccatgactctggggtactgggacatccgtggggtaagcgagggtcctctggtgggtgggacagggggcggaggcggggatgtgtggagtagctgcaggactggctctagggaccgttcctcttcagggctgcccgcctcagaagggcctgtgcatgacgctgtgtgtgtgtttgggggtgggggcgggtagaggaggcgacgggtacgtgcagtatagactaggggctggcctggtgcagagaaagtcaccaagtcagggaccctccatctctgacccgagccgcgggccatctctcccagctggcccacgccatccgcttgctcctggaatacacagactcaagctatgtggaaaagaagtacacgctgggggacggtaatggcaccctcgtgtccgggccctgcccactcacgctgagttggcaccaagcaacccatggtggccacctgtggctgcctctgcaggcctcccctgctggagctgcaggctgtcccttccctgagctcccgtgagtgagccctctggccttgcaaggcagaatgctggggcgggatgctggacaccctgtctaattgggttgggtgtccctcagagcttccctaaaccctggaagccttagccgttgtggggtccagagccctcagtgggattctttctccctgaaccctgggatgtgggactgagtggtcagattctagatccacctgtctcagggatcttgccactggctccttgggagggtccccgggaaggagggctgggctctggggaggtttgttttcacttcttccccaccacagctcctgactatgacagaagccagtggctgaatgaaaaattcaagctgggcctggactttcccaatgtaggtgcaggggaaggggcggttttgggggaaagtgcgacgtgtctctgactgcatctcctctccccaccttagaggtgttaagatcaggagtcttctgcccaattcctctcactcttggctgtctacacagcccttgcatgatgttctgtgtcccagctcatttattagtgtgacagtatttctatctcaggcctgccatgagcaggccctggtctcctctctgcccttgcatatgggaaggggatgctggggagcctggtggcccaactgagcttccccggtttcccatctatccagctgccctacttgattgatggggctcacaagatcacccagagcaatgccatcctgcgctacattgcccgcaagcacaacctgtgtgagtgtgggtggctgcaatgtgcggggggaaggtgacctcctccttggctgggctgtgatgctgagattgagtctgtgttttgtgggtggcaggtggggagacagaagaggagaagattcgtgtggacattttggagaaccaggttatggataaccacatggagctggtcagactgtgctatgacccagattttgtgagtcccacaccccactcccagtcacccatttccctgccttttggcccagaccagggagggacttccaaagtcaggtctgtagcagactccggccagctgactggagacgtctataacctggttctccaaaatgtccacacgaatcttctcctcttctgaagattcttgtggacattttggagaaccagaccacggacaactggatgcaactggtcatgatctgctaccacccagagtttgtgagtctccccagtgagctgcacctggcagagtttggatttggggccaggactcttgcattcctgcacgcactggtcttttcttaagtccttggtaccactcatcctccaagtgctttcccatactatcagcagttattctcacgactccaatgtcatgtcaacaaaagcagaggcaattcccaccaatcttaggacacgatccaggcatcccacggtggaaattcaattcctagatggtaaaatttgtgttcagaatctccttcatctcctctggcctctggcctctgtcatgggtcatttctgtcagttgatttatatcacctacctgctcctagaatatacagactcaagtacaagaccaaggaatgtaatggcaccctcaaattgcatcttctcctcaaagttttccaagtgctgtcattgacatgcaccgggatctgcgcattttcataacagacagctcagaggcagccagagggcctttattcctctccctccttcctttcaacttgaacttctcatctccctggaaactagtcaatgttcattgttttcttctgtcaccccattagaaggaactttctacttctttccctgagctcctttagttctttgcatccttgattctgcccctgtctggatccagaggctgccaggtgctcgggcgctcatgcggctgacccagaggctattgggaggccagtgaggacagattcaggaagagcatctcattctgatcacttcagatagggtctggcacccagtcagagtctaataaatgctgatgtatccaattgaagcctgggcactgccccggttttagttgtggggaagatggctgcttgcctgtggccagcctgggccatctacagccctggggaggccacgtctgtgcagggagcttttgtctgagggtggtgacagctgttttctgcctcaggagaaactgaagccaaaatacttggaggaactccctgaaaagctaaagctctactcagagtttctggggaagcggccatggtttgcaggagacaaggtaaaggaggagtgatatggggaatgagatctgttttacttcatgtgtttcggggttttcagcccacacattcttggccttcttcagatcacctttgtggatttccttgcctatgatgtccttgacatgaagcgtatatttgagcccaagtgcttggacgccttcctaaacttgaaggacttcatctcccgctttgaggtgatgcccccatcctcctttctctttgatgccccttgttcctttctctcctttcagatgctttcccagtcctggagctacacaaagaataactcgtatgtattgagtacgggcttcatgccaggaatcatgcccagcacattatacctatcgtgtagaatttgaaatttccaacattcctacagggtgacagaattatcttgcccattttagagataagaaaactgagaatgagagggtcagtcctttgctcagggtcccagagccagtggaggctgtgctgggctccctgtgagcctctggatctatgggtggcagtcagggctctcccatttgtgacaaaaggagaagcctcaggcctcatccagcctgggtttcacagcccagaacactttgaaagaggcagagcacttcaggaccacggatgcagctggcaatagtaggactgacacacagtggcattgatgttgagtactaaacctgcaggcagtattcatagccacccccagaagctttgcatgatcggacccccatgtggaaaatcctgagatccggagctgtggctggagctggattagggtacatatgtgggtgcccctgttgaagcagtgtgtgttgaagtgctctgtgctggggcactctccttctttatctttcttcctctctttttttccctccaatgttccacgtcttccccctgtgagatgagtagcacactgattttactcctattcaccgaccttctcctctgcatgaggcagggtgtgaggcacagtgggagttgcatagatgactgccccatcctggaaatgagtgcagtgagaggcctgcaggcagagcagcctgtgaggtgtgtgtggcaccacctgggtaccgggcctggggcctgcccctcactcacggggaaccatccctcacctgtgttgaagttgtttgagagcagcaaatcctactttagtacagatttggggatttgaggcattagtccaacaggcttctgagcctagaatctgtttccctttcccactccccatcaagaaatctgcttgctcagctagttcccatcagctctggttctggtccagcctgagcagccttggggttatgtaagaggtggtgggaggggagcggtggggaacagccgagggctggggcatggagcctgcctgggcctggccctggccctttggggagagggagccctggatctctttgaattctttagaagttacatggtcattgaatcctggtaagattgtgtgcagcacacctgagtgtcatgtggcctggctagcagtagtagggctggagatgtgatgggggcacagggacatagggagatttagctcaggtaccaggtggagaagtttggactttatgctttaatgggaatgattagagcctggtctggccttcctttggtggttcacccttaccctattcagtttcatccaggttttgctaagtcattgggtgagatctgtgctctcttcttggctgcacaggtgtgttctgagcccctttgttctgctggaggtcctttctgtgtgtgcaatcctaggcaagccaagaacctccctgtgaaaaaggagaatgtttgtgccgacaaggagtgacaggatctggcatggggtgtggctgggtggaagaggaggagaatttggcaaaaacatgctagaactgaagacagaaccaggctatattccagccctgtcccacttactagctatttgagtgtgaggaagttgctgaacttctgttcttctatatgagaaacggtgataatagaactgaccatggagggtagtcgagtggattttctaagcctgtgttgtaatttctgttggatataaagcacccagcacagtgtagatctttcgtaaatggtagctgttattatggtataacattacttaaaggaagttggaagagttaacttagaagagctggggacctaagagaccgtgtgatgctccagcacttgagcccacatggaaaggctgtggccagggccctgacctgctgtgcctgcagcaaagctacttgagcccttctagacagcagacctggctctggccccttcttcccgccctcagggtttgaagaagatctctgcctacatgaagtccagccaattcctccgaggtcttttgtttggaaagtcagctacatggaacagcaaatagggcccagtgatgccagaagatgggagggaggagccaaccttgctgcctgcgaccctggaggacagcctgactccctggacctgccttcttcctttttccttctttctactctcttctcttccccaaggcctcattggcttcctttcttctaacatcatccctccccgcatcgaggctctttaaagcttcagctccccactgtcctccatcaaagtccccctcctaacgtcttcctttccctgcactaacgccaacctgactgcttttcctgtcagtgcttttctcttctttgagaagccagactgatctctgagctccctagcactgtcctcaaagaccatctgtatgccctgctccctttgctgggtccctaccccagctccgtgtgatgcccagtaaagcctgaaccatgcctgccatgtcttgtcttattccctgaggctcccttgactcaggactgtgctcgaattgtgggtggttttttgtcttctgttgtccacagccagagcttagtggatgggtgtgtgtgtgtgtgtgttgggggtggtgatcaggcaggttcataaatttccttggtcatttctgccctctagccacatccctctgttcctcactgtggggattactacagaaaggtgctctgtgccaagttcctcactcattcgcgctcctgtaggccgtctagaactggcatggttcaaagaggggctaggctgatggggaagggggctgagcagctcccaggcagactgccttctttcaccctgtcctgatagacttccctgatctagatatccttcgtcatgacacttctcaataaaacgtatcccaccgtattgt

SEQ ID NO: 17 - DNA, 61826 bp, Homo sapiens
cctcggggagtggtccgaccgcgggcggccgccggtgaggtaggggcgggaggcggggggagacatggctcggcgcggctggcggcgggcacccctccgccgtggcgtcggcagcagtccccgagcccgcaggctcatgcggcccctttggttgctcctcgcagtgggcgtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggcaagttcctcaacccttgtcagccccttggcgctgcccctttctctgcccgccggctgcttcgcctcctctgctggccctgctcggcctacgttcggctccccttctaattccttccattttctgcctcgccttccccctaccccgcgtttctctgcctcaccccctttcctcttcagcctcgcgccccattttatctgcctctccacacctttttcgcttccgaccccaccccctttttcctccgcacccccagccccccaccctttccctgcctaccaagctcgggacccggggctgaggatggaaaacgagtgggcgcggtgtctggaattgggctgggggctgggggaggggagacaccattgcgatccatttctctggggtgtcagtttgtttaaggttcattgaaactgcagtagtatctctactgcccagaatctggcgttcttttggagccagagtcgacctttactcaacacctagctcctgctacgccctgtcctttcgaggttgcaaaggaaaatcttattcttgtggagtccgaaaaaaaaaacccgaacgtgaaataggctacagaaggcttagggcatttttaatgacatcccatttattgtactatgcctctaatatctgatatggatacctgtggttgacccttccaattcaggcatacaaaagtgaggacgaggaagagttaaggtccttccagaagtatagtgtactatacgatgatcaggacagttcagacaaacagtaattacaaacaccatgcatatgcagtatgggtgacttgctgttggcatgaggttattgaccgattgtagaataaatggcttcgattcttgtgtctcagtctgctttctgaggtttattattattattattattattattttggtgacaaggcgagaaggggtaaatcaaagtgtgggctcagaggcattttgagctgtgctggggcctcaagaggagaaaagatacatattgccgactgtattaatctgtgcgggtattgctaaagagatgagggcggacaaacaattctttctgtgcagtacatgtgtgaagattatcttcatttggagcagttaaaccgatgagcttgttgaggtttgtctctcagacttgcagataggtagatgaagctttggcacaaaagacattgctccatgcaaacccccgccccctagtaaatccagacttctgtaatgtgcatctctcaaggatagcaaggaaaggtagttgtgtgcctcaggaagatgcatgaactcaggcttatttttcatttttaagagaatacagttctgagcctgcgtgtaaaatatctctgctcactaagattcctagtttttagacatattagatggtttttatatttaatatgttttgcatttcatttgcagtgcaccttaagccaaattggccagataagctatatatttctatataattttctgcataacagtgtgtgatttatttactatcctcaacaaacatttgttgataaaccttctatgtattatgctcagaaaatacaaagaggtataagatctttgccttcaagtcacttataggcaggtcatataaagaaaataatggcatcttaaatttggttaaatgccaaatgagtattataaagtaatgaactgatcagagatacttcttttatagagagagatagtatgatgtggtaattaaaggtacaaggctttagaccagaggtcagcaatttttttttttttctgtaaagggccaggtagtaatgattgttgatcttgtggatacgtagatctctgtcgctgttgcattttttttctttgatttttttttctttttataaagttttacaacataaaaactattcttagctctcgggccatacaaaaacagaccaagggctgtagtttgccaacccctgctttagaatcagacctagattcccgtcacactctgcccataggtatgtgtgatcttagacaagtcccttactctcttttaccatcatctatatgttagggatgatgatagtaggattactgtgaggaagaaatgtttttagactagtaactgacccttaagtaaatgcccaagaaatgatagctgtgctattattattattattgctgttacaactgcattttctcagattaggcccagaacaactcttttaattggtcagtctcataagtcaagggacaaatacagtctttttaagagaatcaaataggggctttgaattgccctggaaatattttctctttggtagctggtatcattaacctcatctaactctaggactgaagtagaaaaggattaccgattgcattttgtgaggtttctaagttaataaaaagtgatagagcaccttggtgttagtattttttgaaggaaaaacaagggtatctcttgtggaatgtaaagtgcaagagtgttagtctgggagtcaaatctggagttgacttggcgttctttagcctgtcctattttctcattgtgggcaatgggtgctgtggaccaaacagcctcctaacttaactcgcaagtccagttcgagaatagatgggattgggtcaaagtttctttctttctctctctttcttttctttctttctttctttctctctcttttctttctttctttcttttctttctttctttctttctttcttttctttctttctttctctctctttctttctctctctttctttctttctttttttgtggagggtcaaagtattttcaatagcatgaaaattgaagttttctttttcctttttttatttttgatagagtgttgctctgtcgcctaggctggagtgcagtggtggggtcatagctcactgcagcctcaacctcctgggcttaagtgatcctcccacctcatccttctgagttactgtgactacaggtgtgcatcaccacacctggctaattttttatttttatttttgtggtgacgcgagtgtgggggggtcttcccatgttgcccaggctggtctcaagctcttagctcttgggctcaagctatcctttcaccttggcctcccaaagtgctgggattataagtgtgagccacctcgcctggtcagaaatggaagttttctagtcctatttattgtctgttatttttcttatagctctcacaacatcatagctatcttattattattaatatattattttaaaacctttatttttcagcatgactctggggtcaaaatgggatgcctagacctctaagattcagcccactggtgatcttattcctgtgatattgggttagctacgtaaatcctggaaaatgctattaaaaataagcttttcctttatctgagaagcaggagtaaaaacagtttaaattgccaaagtggtcagtttctagattgtaatatagatcaattgctccagttacaaacacacaattgcaaagtacccacatgttttgctccttgggttagctttcttaagaagcttaaaagtgagtcactgttagtaaaagttgtcgaggtagttaaattaagtctgaaaagtgatcacgcactacactgtgcttacagatggtataaaaagcaaaatatggcagaaatatttgtattgccttaagcttaaggcatctggagtccgaggtttaaccaatgtgattcatcaataaatattgattagatgtctatgatgtatgggatatgatgagaaatacatgtttgagccacagtatctgccctcaaagcacttatcatctaatgactatggctcataccttatttctcatcatatctttcacaaaactaatctgtagaaattgtatcagttttggtcacacttaatgccctagtgatgttcttcctatatttttgactatcagaggcttcaggtgtgattggctggaataatgggctgaaatccatgaggaaaccagtcactgccaactgggagaatcacacattagtagggccttgggtgatgctgattttttttatcactgggagacttttcagcacaggagggtcaggaatgtgtaggagggttaggacctctctgttttgtgaaagatatctctttgtggttgtgttttttttgtttttgtttttgttttgagacgcgttaggacctctctgttttgtgaaagatatctctttgtggttgtgttttttttgtttttgtttttgttttgagacggagtctcgctctgtctcccaggctggagtgcagtggcgctatctcggctcactgcaagctccgcctcctgggttcatgccattcttctgcctcagcctcccgagtagctgggattacaggtgaccgccaccacgcctggctaaattttttgtaattttagtagagatggggtttcactgtgttagccaggatggtctcgatctcctgaccttgtgatccacccacctcggcctcccaaagtgctgggattacaggcatgagccacagcacccagccatggttgtgttctttgttgcctgttagtggtcatttaaagtttcataatataaatattttctgtgcctccctctatgtaggaggctagaagtttctgctttagtctcttaacaaagctctgtttttgtatcctttcactgagaattgctttgactctatgactaggatttggccttttacagaaccctcgttaacttgatctgtgaatttttttcaaataccaatttttcagatgcctggtgccataataaagggatcttgattttgttttcaacctaaataattattctccatgctgttgttttatcgaccaaggtatgtgtttcaaatttgcccaagtgctgagctctcctcagggtacccagtgatgcttcagcatagggttgggcaaacagtagaaccagtgggcactcgggaggcggaggttgcagtgagccgagatcacgccactgcactccaacctcagcaacagagtaggactccgtctcaaaaataaataaataaataaaataaaaaaaaagaaccatggttgggcttggggacatggaaggaatttatgctgccattattagcatttgtagtagcttgtctgtgatttttgcatgtaaatataagaggacagcttttactgagcctcttaattagctcttgtggaatagtagagaaaagagctgtttctgtctcatacaggcagaacgactggatctacaggcttttctcttctaggttatgtctgtcaagtgcagttgctatctaacagtcagtttttaattttgtttttggaggtgagatatttttaaaaggtgtctttcatttattttaaattcgaacctttgtttaaacgtttttaaagttggtgtcattatactactgttcacgaatgaatcattactactctaaaaaatatatgtgactataaattgaccagaaggatccctcctctctgctccctccctgcttcctgggcaactactgcctttttttttttttggacagagtttttgctccattgtcctggctggagtgcggtggcatgatctcaactcactgcaacctccacctcctgggttcaagcaactttcctgcctcagcctcccaagtagctgggattacaggtgcctgccaccacgcccggctaatttttgtatttttagtagagatgaggtttcactatgttggccaggctggtctcgaactcttgacctcaagtgatccacccgcctcggcctcccaaagtgctaggattacacgtgagccactgcgcccggctggcaacgactgctcttatacctcctcatttctgcttcatcacttctcacttgggtctggtttccactcctgctactccactgaaactgctcttatcaaggtcacctatggcctccttgttgccaaacccaatggatacttctaatgcctgccttactcgactttactatagcatttgatagtttttatcacttccttctcctcaaaaatgaattttttccctttcttcctgactttgccaccactggttcctttttttttctactcctgtgggttttccttctcagactccttcatcagctccttctcctctagcagccccttaatgttggctgttaatagatcaaaccccagatctatatcatagtcttcttcccattttacttgctcccctggcgatctcatctacatctgacttcaaccatcttatgactgcacagtgtatatctccagttgagacccctcgctttagctccagataccacatactcaactatgcgtgtgtcacaagtacatccaactcaacgtgtccaaaactgaatgtagccttttcccctgtaaatctgttcatctgtgtatgttccttacctcattgaatgtccttgttatccccctcggtgctcaggccaacttacccacctggttaccaaatcaattaaggttcctcttagtctttcatctcccttcctcagtcactaaatcttcctaaaatataataccttcaaaaaatccttctcgcctcctgtcagtactctcttaggttaggacctaaactcttattgcctgaatgcctacagtagccctgtatctagccttttagaccctctttagtctagaccagtctttctaaagtagaaatctgctatcaagcctctgccttctatgacttcattttacttttgggataaacttcaaattcccttccccaacagataagatcttttatgattcaactcctgccaatctttcaaacctcaactcttgtcactttataagccagccatactaaactacttgattcactggatgggctgtgttgtctccatccttgactgatatgtactactattcccctacgtggaatatacccatttcttctagtttgttacctgcccaggtgacatctctggaaagacttccctaatgtcttactcccccagggttgcatagttgtctcttttctgtttttataataccttgtatacatatatatatatagcattatgattgtttattcagtctgttttcaccaactggaccgagttttccttgacattatgattgtttattcagtctgttttcaccaactggaccgagttttccttgaaggagggaccttgttttcatctctgaaccctggaggcctacctagcatagtacactcattcacgtattaaaagaatggctggctagtcagaatgaaaggcaataggaaggtaaaatgcagctagtagtggtatactatgcatggagttaaggaaagttccagaagtttgggttttatttgtagttgaggtatgtccatacaatgaaatatcgtttggtcgtaaaagtaaatgaggttctgatgcatgctacaacatagataaaccttgaaaatatgctaagtgaaagaagtcagacacaaaaggccatatattgtaggagttcatttatatgaaatgtctagaaaagacaggtccataaagaaagaaagtagatgagtggttgccaggggctgtggattcgggcatgggggaatggagagtgactgctagtaggtgtggggttctttttggagggaaggaaaatgttctagaattagatagtggtgattgatgttcaactttgtgaatacactaaagaccactgaattgtacagtttttaaaaggataaacttttggtgtttgaattagatatcagtaaagccattactaaacaattatagtcgatcaatatagttttatagggctgggcatggtggctcaggtctgtaatcccagcagtttgggaggccgaggtggatggattacaaggtcaggagttcgaccttggtcaggagcctggccaacatggtgaaaccccatctctactaaaaatacaaaaattagccaggtgtgttggtgtgagcctataatcccagctacttgggaggctgaggcaggataattgattggacccgggaggcggaggttgcagtgagccgagatcatgccactgcactccagcctgggcaacagagcaaaatttcgtctcagaaaaaaaaaaaatttagttttacagtacctagaacattgtgcatatttgaatgtcagtaggatgatccagcaatctgtttgatgtcatagtgccagattcaggacttctattccatgttttgattttgaagcagatttttaaaattaaaatctgatcttttagaagtagaagaactcaatcaacctacaaatattattgacttttcaatttgttaaatgtgcattgtttggccagtcatgtgctttgggaataaacttgcgaagtgcattgtttaagtcttataaattgatgaatggaggtgaaaaacaaatttctttttttttttttttgagacagggtttcactttgttgcccaggctggagtgaagtggcatgatctcggctcactgcaacctctgcctcctgggttaaagcaattctcacacctcagcctcctgagtagctgggattacaggcgcccgccaccacgcccggctgattttttgtatcttagtagagttggggtttcaccaagtttcccaggctggtctcgaacttctgagctctcaggcaatccacccatctcggcctcccaaagtgctaagattacaggcatgagccaccgcgcctggccagaaaacacatttctaacacgattgcactgtcgagttgggacacattggagcatattctgtctacagatgatttgaagatattttctccttttgttaccttcctcattacttatttaaatattgatctagaaatgcagtgatctgtgctgttgtcctagggaatgtttttctctcctgtttcactggattatatgaagattgggctgtttgttgtatgaatttagtaatattttaaaacataactgcatttcatctaaaaatcagttctgagctacagggaactaccgtaagagattttctcttatccatagttatgcgtggggtacaaaagaagtggtctctgtcggcaagaagagcttatgttgttcttttttccaggtcttttggtgggccttgtgcttcggtatggcattcatgttccgagtgatgtaaataatgtgaccctgagctgtgaagtgcagtcaagtccaactaccttactggtaaatgttagtggaaaattttatgagtatatgctgaaaggagagattagttcacatgaactcaataatgttcaagataatgaaatgcttagaaaggtaagttcttaaaggaaatctttgaatcttttttgtgtctaactagcagcaaaatgatccaggagaaaataagtaatggatttttaatgatatttaaaataatgagtctttttcaatggagtaaaacctcaattaacaaatgtaataatgtaaggaaatggatatgtctgtacaactcattttctgattgaggttaagtagtataactctttttgtttctctctggattgtttacagcttgttgtgataaatggagactgggattgagttaagcagaatttataagcgtttctttccatttgcagatggtccttatagttttctttttctttttctttctttattttattttttctgagatggagtctcactctgtcacccaggtagagtgcagtggcatgatcttggctcactgcagcctctgtctcctgggttcaagcaattctcctgcctcagcctcccgtgtagctgggattacaggcatccaccaccacacccggctgatttttgtattttttagtagagacggggttctaccatgttggccaggctggtctccaactcctgacctcaagtgaatcccccgcctcggcctcccaaagtgctgggattacaggcatgagccactgcgcccagccggtccttatagttttatagtacttcagcacattggctttatttgataatacctaaaatattctattaatatttctttcaattctttcttgccttgcttgtattctataccgatcacaatttaatctttctttgattcacaatctgacacaacttcaggggccctaagtgtgagtctgagttattgtaccatattgtgcataaagctttatgttagagtttgagttgcaattgtactggctcccagaaatccctggagctgctttctcctgtctccctcataggtttatcatgacgtttctcatgataaacggctcaatgccactttgctcatgtctctttgttttctcctacctttgctgtttgccttcacttctgtctgctacattggcaggacttgacttttttttttttttttttttttttttgacacagggttttactctgtcacccaggctggagtgtagtggcacgatctcagctctctgcaacccccgcctcccaggctcaggtgactctccaacctcagcctccttagtagctcagactacaggcacgtgccaccatacccggctaatttttgtatttttagtagagttggggtttcaccatgttgtctaggcttgtctcaaactcctggactcaggcgaaccacccacctcagcctcccagagtgctaggagtacaggcaggacttgatttttatagctacttggttgtgtttctgaccatctttaatgcttttaaaatttcatatgaacttgaggtttaccttgcagcaggagttctttccacctgtggaaaattccaattccttaaaagttctagttaacgaagttttagcatgggtttgtgtgtagctactttgtgttcatgtcacattctactgcagccttatgaacagaagggggtatttacatttttatggtgactaggtcttaaaatgagtgggctatcggaagtagaaatctgagctgtacagaaactttttactacaatattatacaactttagagatgttatctatgtaagaaatctgtttctttttgccaacaataatactgtactcttaagttttatattaccagtttggggtttcattcattcatttattttttgttgttgttgtttttgtttttttttgtttgtttgtttgtttgtttgagacagagtctcgctctgtcgcccaggctggagtgcagtggcgtgatctcggctcattgcaagctctgcctcctgggttcacgccgttctcctgcctcagcctcccgagtagctgggactacaggcgcccgccaccacgcccggctaattttttgtatttttaatagagacggggtttcaccgtgttagccaggatggtctcgatctcctgactttgtgatccgcccgccttggcctcccaaagtgctgggattacaggcttgagccaccacgcctggcctcattcatttatttttgggatggagttttgctcttgttgcccaagctggagtgcagtggcacaatctcggctcctccgcctcccaggttcaagtaattctcctgtctcagcctcccaagtagcggggattacaggcatgcaccaccatacctggctaattttgtatttttaaaagagatggggttttgccatgtcggtcaggcaggtctcaaactcctgacctcaagtgatccacctgcctcggcctcccaaagtgctgggattacaggcgtgggccacagcacccagccaggcttcttttatttaaagcgaaagtaatgttcatgctttctctttttttttttttttttttttttttttgagacaaagtctcactctttcgcccaggctggagtgcactggcgcgatcttggctcactgcaatctctgcctcccgagttcaagcgactctcctgcctcagcctcctgagtagctgggattacaggcacacgccaccacacccggctaatttttgtatttttagtagagttggggcttcaccatgttggctaggctggccttgaactcttggcttcaggtgatccgcccatccgcccacctccgcctcccaaagtgctgggattacaggtgtgagccactgcgcctggccctatttttaacttttttcttggtttgtttagatggagtcttgctctgtcacccaggctggagtgcagtggtgcagtctcagctcactgcagcctctgcctcccaggttcaagcaattctcctgcctcagcctcctgaaacattttttaatgacatagtattttaatacactttccacagataggccttaactgattgttccaatgctatctcctggtcgtttggttgagaagtagaatagaaactatcctatatgaaatatttttaagttagcacagtaatgttcttgcctttgactagtttaacatatagtattttttctttttgatcatttgataatggaatatgaggtcttctagggaattgatctaaaataactctttattttaacaggttacttttgatccagaagtatttttcaacatattacttcctcctatcatattttatgcaggttatagcctgaaaagggtaagtccttttgtctttcatatactttgaataatcttaaactcagtgggctttgtaatatttgacacttcagaaatgggctgttctttccagattaccctcctttctcctctccttatcctttttagatgctgaaatttatacctgtacaagaatgctttctcttatttatcctagtgaataatgcatttaatcctagtgaataatgcatttcatattagcatagcatagaaaaccttttctttttcaagtaactggtaagtattctaacagtgtaacttttttttttttgtcagagacatttttttcgaaatcttgggtctatcctagcatacgcttttcttggaacagcaatttcttgtttcgttattgggtaagtattttaagcttaaaatactttgtggccttcaaattataattttaaaataatatatttttgatttatgcagtgttatatattcctgactgggtctaaagacttttgcaatattcacgtaggtaataagttgtttgaattttccttaaggccaaagtattaccatatttcaatgacatgaattaaatttgggattagtcacaaagtactacagtaaacccatcttcttactttatcctaatttttttaacagttgatatttttttctaaagtaggactgtgtttattgaacaggtcaataatgtatggctgtgtaacgctgatgaaggtaacgggacaacttgcaggagatttttactttacagattgcctactgtttggtgccattgtatcagcaactgatccaggtatgttttatatgagtggagtttacatacttgaggtgcattgttttgcagtcaaatacatgtgggtttttctttctttgaggtgtagaattcatgattagatacttccttagtactatactttctaattgtggaggaaaaaacaaaattcatgattccttttggcttcagcacaaatttgttttccttttcctttttttttttttaattacatttgcctattactggtccacaagttgacgctgtttcaacaaggactataaggtactttcttcagaaattcatgttggtctttatccctagtgattgagtatagaagatgaactagattatagattagtttaaatgggtaataattatatatttcctttcaagcttttagaaaaccagttccctaaaaatctttcagtttctattcagctgtatgcatttaacagtaagaaaaaatgtttacaaatgattgttagaaggcagttgtgctaatacaggtttgatttggagtcattggaggactttaatatacattaaagaattgtttttataaaattggctttatgattatacagttgtttgtttaatattaacacaacttgttcccctgtgctttaagtgtcagatcttctaaaagttgtgttccagaatgaatttaattgtactgagttaggttttagttttcctgatagagtattggtaaacttaacagctacattcaaattaggaatttggagaagacacagaatggaaaggttggggtaggaacatagactgatgtttttgaactaaggatggaaattttcttttagcatgctttaagactttcgttgaagctcattttgttttactttttaaccttgtaagttaatcatctttaattgtcatccagcacaattaaaggtagaatcctaaggttatctctgcattcctgtgttaactctgataacacagggctttatgggaaggagaaaaatgtgttcaatactctatgagagatattttggctggacacagtggctcatgcatataaatgccagtgctttgggaggccgagatggtaggatcacttgagactgtgagttcgagaccagcctaggcaacacagtgacaccctgtctctacaaaaaaaaagaaaaaaaatagctgagcatgggagtgcgtgcctgtagtcctagctacttgggaggctgaggtgggaggaccacttgagcctaggagtttgaggctgcagtgagctgcagtgaggctgcagtctcattctgcctgggcgagaagggcgagaccctgtctccaaaaaaaaaaaaaaaaaaaaaaaaaaagattttaaaggattagttagagggccattttagagaatttgtgtagtttagcatttttaaaactggaaattaaattgcttccttaaagaccaccaaagctgtcctctcattgtttgtagctactcccattatcaacatgaaggtaggatggttttggcaaggagccggtggtctctggtttctgtgtcctttcattataagcaaggttctcaacttttcaaatcctatgagaaatctgagtccatgagtccattggcttggctacattatttcaactttctggttttgtttgataggactattgcctgaatagcccaagcaaatatcttttgcttatataaagttggactgttatttttttctgaattatgtaagtacttgccccatttctattattttaccattgttagcttgctcttagaagggtgaggtatgggtttcttttagaaattctgcactattgctctactctccttctccccctctcttgatgagctttggtatcagtatattccagctgcaatgctttgtagtagaaactatatcttttaaaatatactggacatggtggctcatgtctttaatcccagtgactcaggaggctgaggcaggaggatcacttgaacctaggggtttgaggctgcagtgaactgtgattgtgccactgtactccagcctgagtgacaaagcaagaccctgtctcttaaaaaaaattaaataaataaaatgcaagtttcttgtttttatgattggcatttgaaaaggctctctcagctgggtctggtggctcacgcttgtaatcccagccctttgggaggctgagacaggtggatcatgaggtcaggagattgagaccatcctgactaacacggtaaaactctgtctctactaaaaatacaaaaaaaattagccaggtgttctggcgggcgcctgtagtcccagctactcgggaggctgaagcaggagaatggcgtgaacccgggaggcggggcttgcagtgagccgagattgcgccactgcactccagtctgggcgacagagcaagactccatctcaaaaaaaaaaaaaaaaaaaaaaccaaaaggctcacctctcgttatattaatttttcatgtccgcttgggtttctttagtaactgagctatgtgacttagtaattaaagttataatataacttcaatttcatctgattttctaagatttctcatataattgctttcctaaaaggaggatttattgtttttcttcttaagctggaatattctcatagttggcttcttattaagacaaatccagcagctgtaattctggtcataaattttaccccaaccaaaaactaaacctatgttttcatttcctactgtctttgctaaacctttgtgcttgcaatttgtaagtcaagtacaaatgagttgtaaggcccaaagaaacaaagtttgcaacattagattcttttcataatattcttcttcattaaagattaatgactacatggtctataagaaattctgaatatattctttgtgggaaagaaatgtacaagacacgattattaacatctgcgtgaagaatgtaggccaactcagttcttcagggttactttcagccatttttaagagagagaggagaagtttgtgcaggtacacaattagaaaagaaaaatatttatataaaattacggggtctttaatatggtaagagaatgtttattaggattgaattctaggaggaaatgaatttctaaataactctcagagtcatctactgaggagaatatgttatatttgtaatgtctaagtattcctctgactctttttacttactagtgactgttcttgctatattccacgagcttcaagttgatgttgaactctatgcacttctttttggtgaaagtgtcctcaatgatgctgttgccatagtgctgtcctcgtaagtgtttgttttcttattatattctgaatattaagtgtgagggtactaggaactgaaagtcacttattgaataaagtacattatgaatggaaacatttggaagaatgaggcatttttttccctcttgaagaaatccatattttatagataaattggaaaatacagggaagagaaaaatatgtactgccaccacctaaagacaattactgtaaacattctagaacatttccttttctatgtatgatattgttacatagttgtgattgtagtgtctgtataattttgtattcggttttaacattacaacatgagcatttaattttttaaattagatttaatattttctttcttttttttttttggagataagagtctcactctatcacacaggctggagtgcagtggcgtgatctcggctcagtgcaacctctgcctcccaggttcaagtgattctcctgcctcagcctcccgagtagctgggattataggcacccgccaccatgcccggctaatttttgtattttagtagagatgggttttcaccatgttgcccaggctggtcttctcctgacctcaggtgatccacctacctcgatttcccaaagtgctgggattacaggcgtgagccactgtgcccggccttaattttttctgaatacataatatattcacgtggctcataaattaaagtcatgtaaaaagttacacacagaaaattcacactcttacatctgtcctcatccacctgtccccctagttccttgtagataactttttttttttttttttgagacgaagtctcgctcctgtcccccaggctggagtgcaatggcacggtcttggctcactgcaacctctgcttcctgggttcaagtgattcttctgcctcagcctcctgagtagctgggattacaggctcctaccaccacgcccggctaatttttgtatttttagtagagacggggtttcaccatgttggccaggttggtctcaaactcccgacctcaggtgatctgcccgcctcggcctcccaaagtgctgagattacaggcgtgagccaccacgcccggcctagataaccatttttattagtctcttacctatcttagtatttctttattcaaatgcaggcacaaccgtgaataaatagtcttatttgcctctcatttcttatttttaaagttacatactgtctatcttctggagaactttgcatgtcaaaagagtgaatattctcattctttgcagctatatagtattctctgtgtgaactgcattattgtttatttgctcagtctcctatagcaggacatttgaagggtttttaatcctttgctgtcccaaaaggtgctgcagtgattaaccttgaacttaccttgttttatacatgtttaggtataatggtaggctgaatgtcccaaagtgagattggtaggtaggttaaagggtaaaatccatttgtaattttgttcgacattgttaaattgctcatcaaagaaattgtagcacttcgcactttcaccattaaattattggtctgtttcctcacagtttcgccagcagaatatttgtcaaacttttatatttttgctaacttgataattgagaaatatctcattgtagcttaatttgtgtttctcttatttgacataatcatttcaaaacatttttaatctctagaagtgttaatatatattatagatatgtagttatgtattacttataccaatttaattgcagacaattttgaatgagcaatattttttatctaattatagaaagtactatacatgttactataaggtgtttgcaggttgaagaatgagtctgaacctctgaggaattcaatcctgcctccctaatcttttttttttttttttttttttttttgagacagagctttgctctgtcacccaggctggggtgcagtggcgcaatatagactcactgcaacctccacctcccaggttcaagcaattctcctgcctcagcctcccgagtagctgggactacgggcatgtgccaccatgcctggctcatttttgtatatttagtaaagacggggtttcactgtgttggccaggctggtttcgaactcctgaccttaggtgatccacctgcctcggcctccccaagtgctagaattacaggcgtgagccaccatgcctggcccctgcctacctactcttattaggcaaatatctaactctataggcagttgcccttacttcataccagaactttctatgagagagaagtaagagcccttcacattttctctttatttttatttctctccttaattttcactttgttagttatgaaagaataaaacatcactggctctgttttgcatagcctgattgtcttctgcaaagttggaaattattatttctcagatgtaacattaatcccttaaacgttgtatgtgaagatatacaaaaggccatatccttttttgtgaatgcaatgtatgtaaatattaccccctccccaccatatttattgccagattttttttgcagctgtctgcaactaatataaatttaacttgagaaataaaacctaaaggctgtaactcatattgatactgaactttagcaccttcaatgatgataggtgcagaataagagttttgtattatttgaagtaagggagaaatggatagtatggttataaaaaatgttataaaaaatgaagcaacaaagattgttgaagcttccagtacgtaggtacatgagcgattaccagcactacaaagtaaagagagtaggtacaggcagtcacttttagcatcgattccctatcctagacaactattctactgttcagtcatcttactagtaactgttgtcttatcattgccctaatggcctaatggattaagagttagaaaatctctgttctggtcttatcttaaactgatgtgccctgtgccttagtttttcctattaataaaattgcctgtttcctgcatctttaggaacagttgattagcgttagaggaaaagataaaaaccctcattgaaagattttgagcttggagttataaataatctatttcctgcaacattaggaatagttgattagtgtgaaaggggtcaaaacctcattgaaagattttaagcttgggggtgtacataccagtgttggtgaagaataaatgctaaaaagagagagccggctgggcgcagtggctcatgcctgtgatcccagcacttcgggaggccgaggcgggcggatcacctgaggtcaggagttcgagaccagcctggccaacatggcaaaaccctgtctctactaaaaatacaaaaattagtcaggcgtggtggcacacgcctgtaatcccagctacctgggaggctgaggcaggagaatttcttgaacccaggaggcggaagttgcggtgacctgagatctcggcactgccctccagcctgagcaacggagcgagactgtctcaaaaaaaaaaaaaaaagagagagagccctttccatagcatttctcacaaagggccatacttcttctcttgcagcctttctcaaacagggttttctgtgagagaatgaagccttataggaaacaatttgagtgagtcttttctcatttcacctaaggatgatagcgagctagtgccattttaaatttgtaagagataatacgttaactcattacaacctcagtgggattctggtggagaaggactgtatcttgagaggaacataacagagaaattgttagctctgtgttttaatagaattgaaaaaatgagttactgcccaaaagctgaagggaaagcagttgtgtgctcgctgtgggagtttactagctggaatgatcagtggtatcatgctcatcattcttcatttaccttttatgtgttttgaagtgggttagatgcagatagtctactttgtgttgaattttcttagtttgaggattatctactgtctgcattctgtgtaagcagctttgcatcaaaggggagggaacccctttttgaaggagttctgtttggcagttaacaggttaaggcaactcatcttgaaatttatgttggaggttgtttttgtttctgtctggtttttttttttcccaacttttattttaagttcaagggtacatgtgcaggatgtgcaggtttgttacataggtaaatatgtgccatggtggtttactgcacaggtcaacccatcacctagatattaagcacagcatccattagctattcttcctgaagcactgtttttttttttttttttttaacctattggagtagcagttattttattttattttattttattttttaaaataatgcttttaatccagtgagggtgaagtgaaattgactccctcatacatggctgcatgaggtagatctatatgtatattgatatattatgttagatacggtatatgtagttagagataaagtatacgttgcatagtattccactgaatggattaccgtgattagcctggggacctaaatccatattagtttaaaatatgttgtttacagtcatttatatttttatgaaagaagatgtacagagagacaacaaacgtgataaactgtttaacttcactaattaccagagatacatgctaggatcagtagccatttctacctattcaattaacaagacataacttttttttttgagacagagttttgctctcgtcacccaggctggagtacaatggcgcggtcttggctcactgctacctccgcctcccaggttcaagcgattctcctgccttagcctcccgagtagctgggattacaggtgcacaccaccatgcccagctaatttttgtatttttagtagaggtggggtttcaccgtgttggccaggctggtctcgaactcccaacctcaggtgatccgtccgcctcggcctcccaaagtgctgggatgataggcaggagccactgtgctcggccagaattgttaatgataatgacatagtacagtcattcttagccaggggcaatttgccaccccctcaccacacacacacaggagatatttgacagtgtctgggggcattttggctgtcatcaatgggggggggttcctattgacatggcctagtgggtagaagttttcaatgcacaggacagcattcccctcaccccacccccatcacagccaacaaataaatacctggccacaaatatcaataatgctgtggttgagaaaccctggtgttgtaaaactagaccactcatacattgttaacattgaaattggtattaccttttatcactatttatgataatgttaaaatatgtttgtggcaaaaatttaaagcatttgactcaaaaagtagaaaattcctgaaatttcagctcagaaataaccactattaggattttaatccagactttttccgttaagatagtagtatacatataaatatgttaataatctttataaacaataaaggcatagtagtatatatacttttctgtagcttttttacttggatattatactatattaatacctctattatcacattgggtggatgcattacaaatttacctctccaatcccctattgattgattaatatttggtattttctaatattgtattatgactagcatggcagtgagcatatttatgtgtaaatctttgtgaatccttgtaaatatttctgtagggtattttttaggagtagaattgctaggtcaatggtatgatcattaaaaaaattgggagatattatcatatttccctccaaaagtgtaatggagaccttttggaaggcagtggagcaacatgtaaaatgagccataggtatagtaatagtctatttttagaaatatagtgcaaggaatagtctaaaatatataaaaagcaagaagatgttctttcagttatttatagtagcaaaaatagtagaagcaactttcaaatgtctaacaatgaggaaatggttgaataaattgtgctgtatccatttggaccattgtgaagtcttaaaaactgtagttataaagactatgaatttttttttttcttgagatggaattttgttcttactgcccaggctggagtgcaatggcatgatgtcagctcactgcaacctccacctcccgggttcatgaggttcacctgccttagcctcccaagtagctgggattacaggcatgcaccaccatgcccggctaattttgtatttttatttttagtagagacggagtttctccatgttggtcaggctggtctcgaactccccatctcaggtgatccgcctgcctcggcctcccaaagtgctgggattacaggcatgagccactgcgtccggccaagactatgaatatttttatgtcattgtcagttaaaaaagcataattcaaaaccacacattcactgtgattacagctaaataagaattagcatgcatgtaacacaaagaggggaaaggaatacagaaggaaaataaaatcgatctatcagggtagtggaatgatgggaagatttttccacctaaactgtacattttattactttcagggtttaaaaaaaagtattcataaaaaatgctactgcctcaagataaaatatcaattgatacagaaaagatgagttaagatttcaatccagaggctagtgtctgcctaagagagaacaaaacgagcctgtcatctgttctcagcccatcatgtttcccatgtgtccttatacattttaatgattaaagaatgaaataatgattagtgtgaatcttgaatttacatgaactaatccagggaaagcaacctcaggaggcatggcataggtattttgttccagagagcattttgaaaaataccaccaaagaaaaagaagattgtatagcaatttttttcttttctccagccagttactgtattttcatgttataatgaaatcagatctcatttatggtagtgggaccctttatatatatgtaggtaaggtagcatggtgttaaaggccatttcatatttatcaaaatgatatcaaatctactgttccaaaatgatctggttgctttgcacatttaaacgtaaatgtttaacattttcaatttagagtgagtctcagaaatttctggatcccattatcagaaattaatattagtgctatatttcaataaaataagtacaaattaggagattttagtttgatcttagattttttttttaacctgggagatatgaaaagaacttgtatatggtatagcaaacatttttcagccttgaatcagaaaaaaacattgcagcaaccacagggagaattcattatatttttaggaatgtgtttttccttcttttctttgacgtgatttgtatgatgttgttgagtctggactttttataatgctggtctctcaattaactgagatgagaactgatttagtaacggtaagcaccgttgccaaagacctgctggcaacagcaattttctcaggcatttctatttcctggggtggtaactgttacaaaagaagctttttcagaccaggtttggactgtgagttcaagatggagagcatctcctataattgcctgtcttggcctggtatagagtgactttctttcagaagtttgaggtggaagatccagctggttatgctgaaagtactgttgagtggattctaattccttgggaggtctttcgagtgctttttcctataatagtccatttcagtgaatgaatagatattaggcatttggcccattctagaattctaaaagttggaagggtccttcagttacctttttttctcataggaaaaacaaaatgtgactgggttgagtattgaataatgttctttatgttcttatgcctctactggaaacaagtgggatttttcattagtttgttcacattagtatgttaaggctttcggacactcagtactagtaattctgaaacagaatcacaaaagaataatactgcacagtatcttggggatgggggaaaaagcttggtgcaattttcatatagaggattttacaatgttctaccccccccccgaaattaacatttaagggaaagccaagttttcttgctagccagatacattgcaggatttttgggtaattttgtccttattttggcaattccaatcgaaagcttgtttttcttctccctctaatttcatctttcaagctctatactacataatgtttttttaaaagtaaaggttgttttcagaagtaaaagcagtctctcttctgtagctcaatagtggcataccagccagctggagacaacagtcacacctttgatgtcacagcgatgttcaagtctattgggatcttccttggaatcttcagtggatcttttgcaatgggtgctgctactggagtggtgacagctttaatatccttttgttatatttatcttttcttgttaacataatatagtagttgaatgctgtattccgttgtttttcctagttctatgattagaattatgttagaattattaatcttataactaagtacttggtttgaaaacattaagcaacagtctttgccaataaataaataaaagaactgtattgttctgcatagggtttggtgccctaaaactttcactgcaagtgtataattagagatgatatctctctgagggtgaattttatagttgtagattaaatagctgtaaaggtagacatattccaaagagcctctgggtgttctgtgttgctggtcagcctggcagtcttttgctctttgtttaataggacaaataggaaatgtacaacagcgacgccgaatgaacaaaatgtgtttccttggttaggatatgtaagagttcatctcagctctcccgattttaaactttgtgctctagagccctggacgggaagcccaaaggacctgagttgtagtcctggtactaccacttagtcaagttattcttgtgttcatgcaaaggccattttatcccggacttcaccaccatgcaatatatccatgtcataaaactgcacttgtgcatcctgaatctataaaaacaaattttatttttatttatttatttgtttttttgagacggagtctcactctttcgcccaggctggagtgcaatggcacgatctcggctcactgcaacctccgcctcccgagttcaagcgattcccccgcctcagcctcccaagtagctgggattacaggtgcgcaacaccacacccagcaagtttttttatatttttagtagagatggggtttcatcatgtcggccaggctgatctcgaactcctgacgtcaagtgatccacccacctcggcctcccaaagtgctgggattacaggcatgagccaccgtgcccggcctaaaaacatgttttaaaccccccacccaaaacaaaaagccagaaggcatgtctggatcacctgctacatgtgctgtgctctgtgtatcaaagctaaagaagacaaacatgacctctgcctccctggtgctttcgatatagtggcagacacaaacatgctagaagctttgacacttcacctctttggatctcagtgtaggaaattggagggtggggacggtaggaaagaggagtgggactagatgatgtctaaagagtttccagctctggcctggtgcagtggctcgtgcctgtaatcctagcactttgggaggccatggcgggcggatcacaaggtcgggagatcgagaccatcctggccaacacggtgaaaccccgtctctactaaaaattcaaaaaattagccgggcatggtggtgggcgcctgtagtcccagctactcgggaggctgaagcgggagaatggcatgaacccaggaggcggagcttgcagtgagccgagatggtgccactgcactccagcctgggcgacagtgcgagactccgtctcaaaaaaacaaaacaaaacaaaaaagtttccagctctaaaacttctatgatacttgtataaaacagatacgttattctttgtcaaggacttcttagtttggtatacttcagccttgtgctggaagaggcttcttttatggctttttataagtgaactgaggcataaagcagcagtaaaaagagttctgaaggtgatgccaagagtgatagtatctcttccccattacaagttccttgagggtagaaagtatatcttgttaatcattttgttgtagtgcctagttgtagaaatgactctagattctagcctgagattggtcgtaacttggcacaggcccttccactgtcagctaacaaatacttgttaaactagtataaagcagtgaagtgcctcaatttcttcatcatggaatgaatgctctatatcatagaagtggtagaggatcaaattcgtgtaaaatctcttggaaattatgtatttttataaatgtaaattgctacaattatggaagctgtctagctttgggtctcagattaatagaggtggcatgttatagatctgatctgttactcccgtctctatctatcctttactgcatggtttctggcaaggtgtgtgatacccgtgaaacaattggagtggctaagccgtaaggcttcctcactgaagggaaggcagctgactcctcagtaagatgctcattttaaaagtctccctattctggtggtaccttattctgagatttctgtgttagagaagctagagaacctttctttcatggttgccttgcttaaactgttattttttctagtcacacttttgtgttacaagatctcattactagccttaacagtcttacgtgacaaagttcaccaaattacgggagttccagttgttggagacaggcctgttcttcttgatgtcctggagtaccttcctcttggctgaagcatggggcttcacaggtaggtgacttgctccctttgattgtcaacccttaaaaggagtgactttgccagtcaattttgctccaagtggatcagctccgttagtatttgaacatacttattgtggttgggatttaggttgttgctttagaacataaaaaaaaattttcagtggaagtggttcctcttaacaaagtaagtcacaaatgagaatttccagacaaagcctataatctactgtgaagaaagaacctcagtataaaaggtgggaaccatccttttatgtgaacttggaatttgttgtctttataggtgtagttgcagtattgttttgtggcatcacacaagcacattatacgtataataatttgtccacggagtctcagcatagaactaaacaggtaagaggaactttatagtttgtgaataggcttttccttctttcagcaaaatagaagtcttttttactaaaaaaaaaaaatagtctttgatctgttcaagatgctatctactcattttggctcctcttcctttgactctaaaagtaggtgggattggcaaaatgaagaatgacagcatttagggtggaaatagatcagcagaatagccagagactgttactattgtggcttcaataaccagtgaagtagcttccctttttctcagtgttttcccaatttaatggcttttaaggggaatgttttggaagctcactctggttttacttgaactactgctgtgtgacgtagataaggttaacttctgatctgaccagacctactaagagatgacataaagaaaattaacttctgatattactagaccttctaagacatgacataggtaagattagcttctgatctgattagacctactaagagaagataaacttccttcagtccgctcaggtgctgcaaagctactatgtttccaggaatgtcaggggactagtcagtggtctggttttatttggtactgaatgatcagttgtgcagggtatctgaagggaattataaaggagataggaatacaatttttccagtcttaggaggtatgtgggacaaatacatgaaaaaagtgtaatgtctggaatagaaataggtgcatacttgattatggctatagtgagaaacagaaggtttaaattttgccaaatgacaagaaggttgtgggattcgcctgaaaaggagtggtgctaaaagcaggagcaacagtatttcttcttccggctagagccacaaatcaagtttatgacctatgcttttccccagcccctcaaaagagattaggctttttcccccaagtgtatacattagggctacaaatcctttttacaaattaattcagtgcaataagtaaagagaagaaaatcagctggcagggggcggtgggggaggggagtcagcatttttccaggtcgtgggaagggaataaaaaacaagaacaggccgggcgctgtggctcacgcctgtaatcccagcattttgggaggccaaagcgggcggatcacccgaggtcagaagttcgagaccagcctggccaacatggtgaaaccccgtctctactaaaaatacaaaaattagccggatgtagtggcttgcgcctgtagtcccagctactcaggaggctgaggtagaagaatcgcttgaacccggaaggcggaggttgcagtgagctgagatcgtgccactgcactccagcctggatgacagagcgagactctgtctcaagaacaaacaaacaaacaacaaaaaactagaacagggtaagagcttccagtgttgttggtgatatgatatgaagcttatgtacatttaagaaatatgaggaataggaatcctagattatgtacttcagattatatgtcatagaagacatcagagaagtaggggaaatggtttgaggcttgaggatctggaaagtatcctagaagaaacagtacccttagaaggatggggaagatttaggaaggcctaggggaggcagtacagataaaggcaggaataaaaagaaggcagtaaagtgtagagcagagggtggcggactccagccctccggccacatccggcccttgccagtgagctaagcatggttttctttccatccatttttaattggttggcaaaagatcaaaagaagaatatgttgtgacccatgacagttatatgaaattcacatttccatgtccaccaataaaattttcttggcacacagccacacccattttttaaaatatatagtctatggctgcttttgtgcttcactggcagagtgaagtagttgtgacagagacttcttggcctgcaaatcctctcatgtttactctctggccattcatgggaaagtttgccgatccctatgttgcaaagtaaagctgggactctggagtcactgtattgttttaaatcctggttctactacttgctggctgtgtgaccaggaggaagttccataacttctctgtgcttcagttttgccatctttgaaaatggagataataataatacctacctcactgagtttttgtgggattaaaacgagataatgcatatgaagtccttagtatagtatcagacacacggtaaaaactgaaaaaggtatagctgttatcattagtataaataagtagtaataatagcatattaaatcatttaaagaaaaataaatatacgcttacttattttaatttttattctcatttttgggtaataaggcaaccctggtttaaagagattaactaatttgcccaaagccacacagccagcaaaggggaagacagggctcaagcctaagcattttcattcttaagcccatgttcttaaccactattctgttatgtgtcagagggctcattgtagataactctggtggccagagggacacgagattatgaagggccttaacttcattcagcaagtatcatataccattgccaaggctatgatgtgaatgggatggggcaggcgggcagcagggtttagttccccccacagatagttctgctatcctacagatcgatctcttccacaatgtggaagcccctatctgtaggacgcttactccctatacgagaggaagacccacgcaaaaagtgaagtcacagggcaagctgggagtacgagagttctcacgaagcactctatgctaggatcagaaagttgaaatgaatcttatagcttgcaagaggaaagtatcttgaaactatcagttttagagattcattggtttgggggagctggaggatgagggatggttagaggtcctttctcatcattatgggtaggaagtgatgaaagtttgactaaggcagtagcagggacacaggaacattaaaaaaaactgacagtttggaggaagaggagaggaataattgaagatggggctttgaagaagggaagctgttaggggaaatgagggggcaacattcctggctttttctgcaggactagaaatgtcgtctccacatttgctcccttctgaaccacatattttgtgtgtatgcatgaagtttatatatatgagtgtctgttttaatatcttagtaatactcatgctttcaaattatgtaactttatttgctggactaatcttttacaatttcgtttcagttgtttgagcttctcaatttcttggcagagaatttcatcttctcctacatggggctgacactgttcaccttccagaaccatgtctttaacccaacatttgtagtaggagcatttgtatcctttattatgtgttttattttgaaaatatttttaattgagattttcatgtgggttttgagtatgtggttcataagaatacatttaaatatatacagttttcctctgagtaaaacaaataaggattccagctcttttttctagtctatttattttattatattctatttcaatttgtggttattgcacaaataatgttgacagattaaaatgacagacaagtgtcccactgttctgccaaccccaaaagataagtgttttccctttattactacagggaaggagaggttggatactggggagcagttagcagtctatgccacagggcagaaggcgaaagataaggaaacgttgaatgaggccactttctttctctttctctccctcccccaacccctctctctccctctctctttctctcatatatatacaaagagtcttataaaataaaaaccccaacctgggcaatgtagcaagaccccatctttacaaacaaaattttaaaaactagccaggtatggtggttcatgcctgtagtctaagctacttgggagggtaaggtggaaggatcccttgagcctaggagtttgaggctgcagtgagctgtgattgggtcactgcagtccagactgggtgacaaagggagaccctgtctcaaaaaaaaaaaaaccaaaaaaccaaaaaacagttggaaggaagaaactgagtatatgaaagagaggaggcaatagtgaaagcctcttgagaaggcaggaatgaaatccaaagcatgtagagagaaattttgccttcactggaaggagagacaactccaccatgactacaggagaggatagggtatgtagaaatgaaggcacatttgtaagatggagccatcctctctgatggcttctatgtttatctgttaagtaggaggtgagatcatctgctgagagtaagatagggagttatctattgtgtaacaaattaccttaaatttagcagcttaaaacaacagacagttattatctcacacagtttctgagggtcaggaatcctggagcagctcatctgggtgattctggctccaggatctcttaagaggtcgcagttgtgctcttggctgggactgcaccttctcaagacttgactagggccagggaatccactgcaagctcactcaactcacatcactgtcagcaagaggcttctattcttcacgtggatatctccatagggcagcttacaacatggcttcttcccccaaactgagtgagctgagagagccctaaaatgaaagccgaagtgccttttgtaacctaatctttgaagaggcataccagcgtcacttccataatattctgttggttatacagaccaacctggtacagtgtgggtggggactacacaagggtgtgaatactaagaggcagggatggttagggactatcttgggggatggcttacacagatcatagggattttgaggaagatggaggttcgtgaaatagttgttgtagagagtgggagaataagttgaccaaagaaactcaacaggactgctaagaagtactagggatccattgtgtttgagaaataggaattagcagtagaaccaatctgccccattgaatgagtttgtccagcagtacttactgtaagcatggaaaaaagagatagttggctccttccaggtttggagttttttcaagtgggtgcaatgaaaacagaaggacaagagatcatagtgttattacatgactgatgcactctaaacacttcatttaatgtttaacattaaaaggtgttattaacatgatgataagaagggaagtgaggaaagaagacattgtttaaggaaagaatatagggatctttggactgaaggtcccagtgctatggaggaatgatcagagtgggatagttgaacacaaaatatggaaggagcaattgtggtcagtgggaatgtttgaataaggaatttttaaaagaaatattttaaaacctcacatcagaatgaagattctgccaaagagattagtggaagtttttttttttttaattaaaactctagataggatctctgttagaaagcgaagtattactgaaatactattctgcagagccttagtctgtgaatgaactttaggcaaaaaagataaagtactgttaataagagaagttcttagctgaaagataaccatgagatcagtaacttaatgtcctgctagtcttggagaaaatttggagcagtaaagtggctcgatccactatacttagtctggaaacaaagctaaatattctctgtaggtttctgagtctgttaggaattaaaattcctcaatacaaaatcctaccatgaaaatggcctcgtaacaggagagagttgctctatttctggctatgttagttaggacataggttggtttcatgtgaaaagactcaaactaatccaggtttaaacaacatagaaatttctttcttatctaaaaatctgaactggtatggcagttctgctgcatagggtcatcagggactgaagcaatattgttgctaacatccttagggacttgctgttgttcttgtgatccaacgtggctcacccctgtctgcccgttgccttgaagggcttgacccagaatgtgcacacgtcccttccacttaacatcattgattacacctactcacaagggaggctaggagttatatactttatctgggtggctgcataaagatgaaagggaggagtgccaactaccaaggaagaaagcaagaacagatgttggggagaactagcagtcactgccacgttggcccacatgtttcgtggttacattttcttttctttttagggaatcactttttaaaataaatgtttgattttagaatagttttaggtttacagaaaaattgtgaagataatacagaaagttctcatatgccccgcactcagtttcccctattattaacatattagcatggtacatttgtcacagtgaatgaactaatattgatattactaactaacgtttgaactttattctgattcccatagtttttccctaatgtcctttttctattccagggtcccatccaggataccacattacatttagttgtcatgtccccttaggctctgcctgactgtgacagtttctcatatgtgttcattgtttttggtgacccttgacagtgttgaggggtactagccatgtgttttgtagaatgtcctgcagttggaacttgtctgatattttccccatgattagactggagttacatgttctttgggaggaagaccacagaggtaaaatgccattctcatcacattatatgaagggtatatacttaataatgttgacgatagtcttaatcacttggttgagatagtgtttgtcagatttatccattataaagttacacattccccccccttcccccgccatgttgtactgcgtggaaggaagttgctatgagcaaggattgaggaatggggagttaggttccacctccttgaggacagagtatcagcaaaattatttggaatttttcacacaggagatttatctattcttcctcatttattgttttattcagtcattttttaattattattacttttttttttgagacagaatttcactcttgttgcccagactggagtgcaatggcatgatctcagcctactgcaacctccgcctcccgggtccaggcgattttcctgtctcatcctcctgagtagctgagattacaggcatgatctgagattacaggcatgcgccaccacgcccggctaatttttatattttcagtagaggcagggtttcgccatgttggccactctggtcttgaactcctgacctcaagtgatctgcgcctctcagcctcccaaagtgctggaattacaggcgtgagccaccacacccagcccagtcatttatttatatcaatatggattcactgatatttattttatactttgagttataatacaacttttttattttcttgctgaaactgttccagcttggccattgagagctcttttggcaggctctcctgtgtgcctttgatatatcctcatcattgtttttaatttttatcttcatcattgtttttaattttttttttttgagtacttccttactccctggaactataagatgcttcaggctcatcttgtatctgttctggctcagcccaagaattggccatttctccaagaagtcctggttccttttattggagaatagtattagaaaccaaaatctgagcactaggtgtgctcagtgttacttggtgtctttgcttctaggccgtctcagctgacagattgcttctaggctctctcagctgacagagcaaggagttagatatgtatatatctatatatccatatatgtagatatatatactaactcatatatacacatatatctatacatatttctgcatataaccatctgtatctctgttaagctcaatatgggttcatactgatgtctccaactttaattcattaccacatggatgattctggcctcctcctctttctgaactgtaaactcccattctaacagtaagaaaccttgttgtcaccacttgccatccatttacctaattgttcagtttcagtatacatgtataatagtttcagaattgttaaccagtgttcccatgggaaacagctttgtcatgagcatagaatgcttttgtgcagtgtcttctgtctttagtcttacagattcttctgttttccaaagttacttagaccaacaccattccccctaccttgtttgttttgagacagggtctcgctcttgtcacccaggctggagtgcagtggcacgatctcagctcactgcagcctccatctcctgggttcaagcaattctcgtgcctcagccaccagagtagctgggattacaggtgtacaccaccacacccggctcatttttgtatttttaatagagacaggtttttgccatgatggccaggctggtcttgaactcctggcctcaagctatcctcccgccccggtctcccaaaatgctgggattacaagtgtgagccaccatgtctggccttgttctgtttttaatcttagattttcccttatatttttctcaggaaatgggatggagactgtatcgtgactcctgaaataaaaattgccatcataaagcaggagtcccatagacagcaaactggagaaaaagatactaaaattggtttctagttaaaaccaatctgaattcacattaaactttccctttgaagcaagttggaagtataaacttagtggagtacagtgggactggtagccattttagtgctgtgaggtggtgattcagctgcccttttctttgttctgaggaaggaaggggaagttttctcagtattactcttcttcctaccaacactgacaatgaaagtgaattaacctattctattaataatcttaaaagtatagtaaagaaactgcttttaaacgtgtttctcttaatctagtaaatttcctgcatgttacacttgctctgtctgatttggtagcaactagccaaatgtgattattttaatttgaagtaattaaaatgaaataaattttcagttccttgatcactctagccacatttcaggtgctcaccaaattggacagttcagatatagaaaatttccatcattgcagaaagttctgttggacagtgttatgttagacaatggaaccaagagactgtgtgttagaaactgagttccctaaaatagtctttcaccatcttgagtgtatagtctaaataatattaatagtaaaatgaaatgatccttaacctattaataattttaggttgctattttcttgggaagagctgccaatatttaccccttgtccctcttacttaatttgggtagaagaagtaagattggatcaaattttcaacacatgatgatgtttgctggtaagttgtaactttcttctcttgcccacttcaagcaaccattcacaatgcgtgtgccagcttgatgtaacactgagatgttatgctggtcatataatactcctttatttttatattatttatttatttagagacactgtttcactctgtcgcccaggctgtagtgcagtggcacgatcttggctcactgcaacctctgcctcccaggttcaagcaattctcgtgcctcagcctcccaagtagctgggattacaaggcatgcaccaatatgcctggctaatttttgtatttttagtagagatggggtttcgccatgttggccaggctggtcacgaactcctgacctcaagtaatccacccaccttggcctttcaaagtgctaggattataggcatgaggcaccacgcctggcctataatactcctttaaacattgaagttgcatccttgaatagaaaaagaaaatgtatatatatatatatatatatatatatatatatatatatatatatatatatatatatatagtgtcccattcccttctgtgggaatttttcatattctgattccaaatccttggttcagaattatgtcatacaaagtgagaaagataaggatgaagtcattttcaaacaaaaaccagtaggtgaatgtatagcagttcttttcataattgccaaaacctggaaacaacccacttgtctgtctctcagtggtcaaatagctaatcaaactgtgatacatccatgctatggaatactactgtgcactaaaaagaacaaacaatttacccatacagcatggatgaatctcagaggcattatgctaagtgcaagaagccagtcttgaaaggttacctgctgtgtgattccctttatatgacattcacaaaaagacaaagtcgtagcgatggggaatgcatcagtggttgccaggggtttgatggagtgacaagaggttagactaaaaaagggtaatacaaagaaatttgacagggggagggatgatgaaaccattctgtgtcttgattgtagtagtagtcacacacacctctatgaatttgccaatattcatgtggctatagaccaaaaagagtgaattttactgtttgtaaatgaaaagtgaatttaaaaaaattactgaaacatcaatgcatgtcagtaagtaacatacacaaattctatttctgtttgtactttttttttttttccgagatggagtcttgctctgtcactcaggttggagtgcagtggtacaatctcagctcactgtaacctctgcctccctggttcaagcaattctgcctcagcctcccaagtagctgggattacaggcatgcgccatcatggctggctgatttttgtatttttagtagagatggggtttcggcatgttggtcaggctggtctcgaactcctgacctcaggtgatctgcccacctcggcctcccaaagtgctgggattacaggtgtgagccaccatgcacagcctggacatatttaagtatgttaatatttactgcatatttgttcacatgcttctaagtttttagaacgtgctttcttgctctgaatttatgaagcttgcattggtaatgagttattgaagaaataccttttctgttcccctgtaggccttcgtggtgcaatggcatttgccttggccattcgagatactgccacttatgcacggcaaatgatgttcagcaccacgcttctgattgtgttttttaccgtgtgggtatttggtggtggcaccactgcaatgctgtcatgcttgcatatcaggtaagtactaactagagacctcattttaagattaaattttaatttggtttatttttctgcctgttttcaatttttaatctttggagaatctgtaatgttttattttttccttttaaaaagtatgtaatatatagtacagaaaaaggaaaatatatatgcaaaagaaaaattcattgttaagactttgagggatatctttccagatcttttgctatacatgatatatatttttgacaaaaaggggcaacactgaaggtactcttgtagcctgatttttaaatgtaatatagcatggacatttacattgtaaatatatttacatcattgctttaatggctgcatatgtcctgatttacttaatcaaaaccctgttgttggacttttgtattgtttctaggattttgctattaccattaccatttgaggattttgctgttactattaccgttaacgatgtgaacattcttaaatgtatacaccactgtgtacttgtttgattattttttagaatgcatgtctagaaatgaaattgcttgctcaaaaggatatgtatatatttaaggcttttgatcaatatcaccaggtcagataaaaaatttgccttccacctgcaatgtatgagacaatgcggtttactccaaccctaatcactactagatattatcatttttctcatcagcactgtttttaacctaacaatccaaagccgagatcgtgaggtcttagtcttgaatgtgtaccagttaatgtattcaatttgaaagctcccttgtatctcaagagttctgcatttgtttccatggatacagcagcctatgctgctaaagcctttgtagatttgagttctgtgtttggctgaaacttcatagacattaagagctaccaagcttccagaatacataggactcattagagaaaacagtatttcacactttatagatcctgtcctccatttttttaaattctattacaccttttttaagacttctaaaaaccagccagccctaaatcacactttgaatgttgttgttattgtcttaatttctctttactattcaaatctcttataatttctgtgcttttattgtgcatagtataaaatacacaaaaataatgttcttataaccttaattattactttagggaggacctggcatttattgaacacttactatgtgctgggcattgtgctaagtacattttacatatttatccaaacatgataactccattttacaagggatgaaatagaggcttagaaaggttctgagttgttcaaggtcatctggataattaaatggcaggcagaggagcctccagtctttcttaatttttttagaaattaatttcatcaaataatggtcatggtacattttgaaaggacacagttcctttcttttctcaagagcttgtagatgaagactttccctcattgtcctaaggataacaaaattaaatgtaagaacaaaccaaacaaaatatctacgcttaccatccccgcaaaaagaaaagacaaaaacgtacctactcacacaaaatttaatctacatcactagctgtcaaagctctttggccgcatagtgcctgtcctgtaacatagttggtcacttaattataatattgtcttatagtcttaggttacttcttattgccttcttgttttattggcattattcttggcctcttcgtgaacaggggctgtattttaagcttttcttccctccccccaaatttgtctagtacaattttaagggcactgcaaagtcctgaaagtttaagattcatgcagacttagacttggctttgagttcttgccccttcactgatgaattctgtgatctttggcaagttctttaaccttttaaagcctcggtttcctcatctgtaacatgtatgttatagtacctacctccttgggttgttgtaaggattcagtgagctaatatctgtaaagttcttagcacagcatttcaaattaccttttattcattcattcaataaacatttactgaacaccagccatgtgccgggcactgtaggttacaactcagtggttctttttttttttttgagacagagtcttgctctgtcgcttaggctggagtgcagtggtgcaatctcagctcgttgcaacctccgcctcccaggttcaagcaattctcctgcctcagcctcccaagtagctgggattacaggcatgcaccaccacacctggctaatttttgtatttttagtagatatggggtttcaccatgttggccaggctggtctcaaactcctggcctcaagtgattcgcccgcctcagcctcccaaagtattgggattacaggcatgagccatctcacccagcctcagtgcttcttaactggggagaattttgccccccgcccaagggacatttggcactttctggagacatttttggttgtcacaactggaagagggggcctctgctggcatctagtgagtagaggccaaggatgctgctaaacatgctacaatgcataggacaggctcctcaccacctgccaacagagaattatctaggccagaatgtcagtaatgctagggttaagaaatcctcctctagagaagcacagtgatcaaaataagatagaaaaggttcctcgactcataacatccatactttagtgagagaagacagacaataagctagtaacacataaatgaacctgataactgcagatgatattaaatgctgtgatgggaatcgggcaaggtactgtgatagtgactggggatgggggtgtttttgatacaaggaggccagggacggtttctttgagaggttatgtttgagttcagtcttacctacgtgactagatggtgccagttaaacagtcatcaggaagaagagcagtctaggcagagggaagagcaagttgtacaaatgtcctgaggaagggacaaacttggcctgttgaatgaacaggaaaaaaactctcatggccggagtatagtgactgaagggtagataggaagtgaggttggcaagatcctatggaagcaggggttctgcacacttaactgtcaagggccagagagtaaatatatcaggctttggaggccatatggtctgtctcagctactcaactctagtgtgaaagcagccctagacaatatataaatcaattggtgtggttgtatcccagtaaaactttatttacaaaaacagaagaggtgctgatgtggcctgtaggctgtactttgtggacccctaatgtatagtcttgtggaacatggtaagggatttggattttaaaatacaattggaaatcctggaggattttaaagcaagggagtgacatgaagtcatttacagtgtaaaaggttcactttagttgtcatgtgaacggtggatccacagtaaatttgaaacagccagctattcccatgtcctttcacatagtttgtgacagtcacatttctatcatttactacacatgctttgcacttctgcgtctctgagcctttgctcatactgttccctctgcctggaatgctctttcactgtcagtaaatgacacagctaagtgccacctccttttccctctgttcttttccctcggaaccactcttatgttggtgcaacattgggcctcttcattgtagcacttattttattcagtcttgtgataatattgttataagagctgccacttagtgttaatgtttcagatactcttttaaaagcttttcatacattttctcattaaatccttgcagcaactctgtgtggtggatattagccccattttccaggtgataaagtgatgatttataagactgcctcacttgactgagttcacacagctagaaagcagccaagtccagatttgaacccagagctccctgatagaagcccttagggattatgccctagttgtgttggtttcccccactagtctgtgagttccttgagggcaggggccatgtttaattcatttctatgccctgtgcctagtacagtgcctggcaaataataagtgctctataaatgtttattacattgacttagcttctaataatgtaccatctattacaagtgtgctatcttcaagaccactagatgtcactggagatgcataaatgtggttagagtttaatgtgactgagaagatgttaaaacagctcctggccattttaacaaaggaaaaatgagccattctttgaattatgaatctggtcatagcaatctgttttcaggtccttgaccatggttcccttgctttccagatgcagccttgcatcattttctcccttcagtgttatttgtgttctgggatgctactgctacagcttctagtactgctattttttctgtgttgtctgtagtagttaatttaatcaataaacatttgagcacctattgtgtgtcaggtactgtgctagactctggggatacagagatgaattgagacatggcctttaccctcaaggaactcacagtctttttggggagactgacaggtaaataactatactctactgtgctaagtatcataataaaggactgtagaaagtgctgcagatgcacagaggagaaaatgattctgcttgaaggggtcgtagaatggttactttggaacttgaaaatcgcttaaaaaatgagggaaagcacattgcagctggagagaacagcatgagcaaaggcatgggaggcacaggagaggatggatttggggagatgagcaggcaggtatagctagaatggggcatgtagaagagaatgatgggaaatgaggatggaaaagtaggttggagtggggtggggatgctagtttgtagagagtcttgaatgccccacaaaagacttcagacttgaccctctgggttgtaagccactctcagagtcctttgtcaagggagtaacacagcgagctctatgctggcgacagctgactctcggggagagcctggcagctggaaaagcttccacgacagagcccgtgagcctcaggatgagggctgcccttgagcagttgggatggaaaggagagaagacttgagagaccgtttagaggaggaatgaacagagtttgtgagtgcccgtgtttagggaatagagaggagccagagaactttgtagtgaagcttttccctgggatacagaaagcaggaattttaaacagataaaacaagagttgtgaagaagcaaggctaatgtctatccattagcctatgaaaaacctgtaattgggccctctcttcagtcatcgtaacagaatgttgccatgagagctgcgaagtgaattgcactgtgccatccttgtttttggagctagccagtaattcttatttagcaactggggcagtgctgctctccctgattccgcttcgagtggacctatattcagagaaaaaaaatgctgtttttttctgaaactggtaagtaagattgcaggaagagaatcatgggtacaccctgcttgccttagaatccaagctgttgctaaggaaagtggcaggagccaaaaatctgcatcaacagctatagagaagcaagaaaacattaaccattccatagcttctgtgttgagaaaagtagttgcctgacaatgtatatgtgtgaatagaccattttttggcttcaaaatctcatttgctctttgtctttctcctttagggttggtgttgattcagaccaagaacacttggtaaatatgcgtttttgttgttcctggcatttctgtcaaatgtgcagtcatttggaaagaaaacaatctactataaacttcaaccttctatttagatcctgtcctctttgcctcagctttggaggaatgatatcattcctggcttttctcactgctccatagagacaaaaccaagtttgccacagtgccatagtgtgtggttatcaagggtgacagctttcatgtctctgggccatcctgcctgggcttttgtcccagaggagagcagtcttttaagcactcctgggttttcgagtgactcctctggcacggggaggctttttccactttggtttgcgcatgaaggcttgtctctgatgtaagccccactccagctgctcttcctgtgtaactttcaaatcgaatgaccagcagctgccctagagaactgcctagaagcttttgaatcttcaaccagtcttccctgcctgctcagggaaacgcactttcttaccttgcccctcagccttggccacgtttccttgcttccttccttctgttgtgtcagtttctcagttgttgctatgaacttgagcccgttggactgaatgcattgtaactcactgccctctctagactgactacccttgtctggtattttccatctgtttttcaattgcttctgagcaccattgaatatgtgtctccatatcagacgttagatgagaaatcacagaaattagatttttgaacatggaaagcatctctttcaaaacacaatttttttcttgtcagaaacaaaccacagtcagtatatttgtcttcagggtgaggttaaaaaaaacatttctcagattcatttcctaaatgctaattttgttagctgttgagtgatgagtgtgaatgtatgtatgagatatagtaagtacttgactcttgtggtcagagccttaaagtagaattccatgggcttgacatacttgtaaaaaccaagctggataaattcccatgatgccgggctcctggtgtagtgtccaaggggtgataattcctcagtgcctcctccctgtgtgaaaacaagaataaagttaatcatgcagttcaaaagacaaatgctcgatcactgtgtaagtctccaccagctgtgtcacctgtgtaaccacagaggagaaatggaaaaggagtgacagggagagagccaggtaggtgagtgccagtcgtgacatacagaacaaaggaccgttttttttcccataccttcaaaaccctatggctgggccgggcatggtggctcacgcctgtaatcccagcatattgggaggccaaagcgggtggatcacacgaggtcaggaattcgagaccagcctggccaacatggtgaaaccctgtctctgctaaaaatacagaaattagctgggcgtggtggtgggtgcctgtagtcccagctactcaggaaactgaggcaggagatcgtgccactgcactccagcctgggcaacagagcgagactctgtctggaaaaacaaaaacaaaataaaaaaaaaacaaccctgtggctgtcttggttatattgttcctttaatattttgaatgtccacgagaaagcacagaggaaccttatactaagtatggagtgtgtgggggtggggtatacaggtgttcatgtggtgaggggtggtgaaatgttgttcttcaagaggtggaggcacagaaagatacttctatgatgtgaaaggaattgcaggtgttcttcagctttcgtaagcccatacagtgtttccaaacatttttgtgttatatataagttgatacatgacacgtgacacgttgaagcagagagaaatttattttgagcattaggaaggacaggaagaagccaaaacccagaatctaaactctgtgcttgcttgcttatttatttatttatttatttacttacttactgagatgaagtttcactctgtcggtcatgctagagtgcagtggcacgatctcaggtcactgcaacctccacctcccagattcaagcaattctcttgcctcacccttccaggtagctgagactataggtgcctgccaccacgcccagctcatttttttgtgtgtttttagtagagacggggtttccccatattggtcaggctggactcgaactcctgacctcaagtgatatacccgccttggcttcccaaagtgttgggattacaggcatgagccactgtgtctggcctaaattctgtgcttttagaaaagaagattatggaaacatagaacatgagcactggaaagggccttcagaattctctaaccctcatcatgtttttatacatgaagaaattcgggcccagagagagaaagggacttgcttaaactacttaatgtcaataagctgggactggaagcagattgcctaactgcccaactgctgactgcaccatattacaaataaagacacagtttatatttttggaaacttttagaagacgcctacttgctatgttagtttctcctcctagctggtcaggcttaccatggaatttccctacttgtttttattttgctagtgtttcaagaacatagtagcaactttgaagttgctagttattttcgagatccatgacgactcccaaatatagggatgttgatgtgatattttctaaggtgctattattacattgagagttaagtctttcaggttcagtacatgaattataccacattgattttttttcttttttttgagatggagtctcgctctgtcgccgagtctggagtgcagtggcacgatctcggctcactgcaacctctacctcccgggttcaagtgaacttcctgcctcagcctcctgagtagctgggattacaggcaggccccaccacgcctggctaatttttgtatttttagtagaaacggggtttcaccatgttggtcaggctggtctcgaactcctgatctcgtgatctgcctgcctcggcctcccaaagtgctgggattacaggcatgagccaccacacccggcccccacattgattttttaagtgagagtagattcgtaagttagcaagcagcctgagtaatagaggtgttcagaaaaacatttcaatttcctattccaaagctgcaatatacaaactattaaatttctaatgttacccttgttggagagtgtcttataatatagtagcctctatttctgattctccaaaggaatggctctaaataaatgttcatatctttgtatagatattgatttctgtattatctatctgcagggtgttcctgaaaatgaaaggagaactaccaaagcagagagtgcttggcttttccggatgtggtacaactttgatcataagtatccttaattgagggaaaaaaaaaaaggataatgtggacatagataattacagtttaatggaacaagtgttttgactattctcttcctggagcagaatataaaacctacctttcatcttccctttccccatcagtgctgtggaaaaggaaacccacacagacagattcctcttcaaacccatgaaaccgtagggactggtcatttcagaagctggctgtgtaaagggaaccaaagcccaaatgacatactttctttgatatataggtttatttattgagcaaactttaatatttgttgtcctttagctaatttagtgaatcccacagaaggtatttcttggttcttgtctgcgtacttggcagggtaagagaggaaaggcttgggaaaaagcatgagaatgaaatcaaaatgcgataatgttcaatactgcgctgttcagcaatacacttttttttcccctgacctttccaaagactaggagattctctctgttcagcatgccacagatagctaatgtttttgtttgccagatttccttcttgccctgttgtaagtctgtttcatagctgtactttgagtagtgttgatattctataacctctttaaatcagggatccccaactcccgggccgcggaccagtactggtccgtggcctgttgggaaccgggccacacagcaggaggtgagcaatgggccagtgaacattaccacctgagctccgcctcctgtcagatgagcagcattagattctcacaggagcccgaaccctgttgtgaactgcacttgcgagggatctaggttacatactccttatgagaatctaatgtctgatgatgtgaggtggaacagttttatcccaaaactgttttgttcccagcccagtccatggaaaaattgtcttccacaaaaccggtccctggtgccaaaagagttggggaccactgctttaaatcatgccttttaaacattttatcattattaaaattaatttcttatttgaaaattcacctagcaaaaacagccatggagttctttcaggctctgatttatcagtaaatgattcaaaacttggtttatgttctattgaagcaaattggagacaaccgtgtaagaaatttgtccttgctttcaactttctgatgaaagccttgtatatttaagaaaaatcacttgacacttaatgattagaagctactacttaccatgttctgtttggtaatttttgcattcactgcttgcaagtacttcaaaattaaattattgtatggaaacaagaatgcaagcatatctggggtattaagactcccattagagaaagagagcctggctcttaaaattttttaaagattatgtcattacttttggctccattgtcagggttttggatataagccactctcatatctcttggggctttttcatccctctaatttagcaataattttttagtgagttttctgcataaaatgttttgtacattttctacataatatataaaacagttcaatgatcctaatgttgagaaagcgtagaataatagcttattcttctgtatattttatggaagtaaacaccaaggcttgtttgactcagtactgccctattaagtcctactcaatgaagacctgatcattttaatacctagtgccctgatataattaaatattcattattttagatttcagttcatttgtgtaggcaaatgatttgttataattgagctataacttgaatacaataaagtacacgaatcttaagtgtacagcttaatgaatttcaacctgtgtcaacaactgtgtgcctcccacccatacaaagatacaaatgaacattctctatccccctccacaaaggggtaaccatgattctgactttcatcaacatgggttagttttacctgattttgatctttatatatatggattcatatattaggtattcgtttctgtcttgcttctttcactcgacatctgtgtaatttatccctattgtttcatgtaacagcaattcattctttttttattgctgtagtagggtagagctctgtagtaggaatatactacaggatttttgtttgtaaccagtctactgttaataaatatttgggttggttctagcttttggctattacaaaaacctgcatgaatatatatcttttggtggacatagcactcatttctcttgggtatataccaaggagtgcaaagagtggaatttaggacaagtatatgtttaacgtgttttttgtttgtttgtttgtttgtttgtttgtttgcagtagtgtctggctctgtcacccaggctggaatgcagtggcacaatcttggctcactgcaacctctgcctcccaggctcaagtgatcctctaaacacagcctcctgggtagctgggactcctggtgcatgtcatcacacccagctatttttttttttttttttctcaatgtagagacatggtttcaccatgtttcccaggctggccttgaactctgggactcaagtgatccacccacctcagcctcccaaagtgctggaattataggagtgagccacttgcccagcctgtttagctttaaaacagacattgccaaccaaccagttttccagagtgattgcaaccagtttaattggttttaaccaacttggtgaatttatgattatttccatcagcaaattaagggagttctatttttcagtcttttaaattttagccattttgatgggtgtgtagtgatatctcatatggtttaatttgcatttctctgatgaccagagaggctgagcaccttttcttgttttttgaccatttagatatcctcttttgtgaagtctaagtctttcgtccattgtttaactgagttgtttttttctctcattgatttatagttctctctatattcctgaattgggttttttgttgttgattattgtattttttctcagtctgtagcttgccttttcattttcttaatcctgtatttaaggagtagaagttcttcaatttaatgaagtctattacattttgtttatttttaagataagttcccactctctcacccaggctggagtgcagtggtgcaatcatagttcactgtagccccaacctcctgggctcaggtgatcctcctgcctcagcctcctgaatagctaggactacaggtgcatggcaccacatccagctagtttttaaaagttttttatacagacaggttctcactttgttgcccaggctagaagtccattttattcaccttttatggttagtgttttctgtgtcttaagaaatcttccatatcccaaggtcgtgaagatattttcctgtttttttctagaagtatgattgctttaactatcacatttaagtctttgatccatcacaaattcatttttgtgcatggtgagagatagtgggtgaagatctacttttttccatatgcatatccagttgatgcagcaccatttattgaaaaatatcatccttaccccactgaattgcagtacaatctttgttgtaaatcacttggctgtataagtggggataagtttctggactctcttttttaatcctgtttctctatttttatatcaataccacaccctttttattactgtactttataataagtcttgctatccagtagagtaattaaaatctggctttgttcttctccagtatagccttggctattttgggtgctttgcgttttcctttaaattttagaaacagcttgtcaatttacacacatgtgcatgtgcacacacacgcacacacacaactgctggcaagtttattgggtttgtattgaatccataaatgaatttggagagaaatgatatcataacaatattgagacttccatatcataaacacagcatattgctccactcatttaggtcttttaaaatttctctcattaacgatttgtacttttcagtacacagctcttgtacattttcattagatttattcctaagtatttgatgtttttgatcctattgcaaatggtatttactctgttttatacttgtttgatgtaaatatatagatagaaaattggatatttatttatttatttatttatttatttattgagacagagtctcactctgttgcccaggcaggagtgcagtggcacaatctcggctcactgcaacctctgcctcccggattcaagtgattcttctgcctcagcctcccaagtagctgggactacaggcgcccgccaccaggcccagctaattttttgtatttttggtagagatggtgtttcaccgtgtttgccaggatggtctcgatctcctgaccttgtgatctgcccgcctcagcctcccaaagtgctgggattacaggcgtgagccactgtgcccagcctaaaatttgattttatatatggaccttgggtccagcaatcttgctaagttcacttatgatttctaatagatactttttggtcttctatatacataattaaatgatctatgactaattatttttttttcttttccaatccctgtatttcttttttgtgtctttttacatcagcttttttaggggacttcttcagtgcaatggtgaatataagtgatgatacaggacattcttaccttattcctgacctcagagggaaatttttcaatatttcaccattaagtacgatgttagctatacgtttttggatatatcctttagcaggttaagagcattctcttttatttctagtctgctgagagtttttatcatgagtttttgtctgctgagaatttttagtatcagatgctttttctgcatcgagatgatcatgtgtttatatttttcttctttaatctgttattttgattttcattgattgattgtttgaatgttaaactagtcttgcattgctggaacaaattccacttggtcatgatgtgttatcctttgtgtatatctctggatttaatttgctaatattttgcatctgatttttgtgtctatttttatgaacaatattggcttgtgattttttcttatagtgtccttgtcaggtttctataacaagattaagctggcctcataaaatgaatcaggaagtattccctcattttctgttctctgaaggagtgataagattagtgttattattatttttttttaatgttaggaaagttttaccagtgaagccatttgagcctggagctttctgtaggagaaagtttttaatttcattaataaatacaggactatctaggtttttttttctttttttttttctttttttaaaaccatttgtcatcatctggcgagtttttttttctaaggaattttttcttgtagagtcaaacatcaagacttgttagcctcagtactacccattcagtaccagaagatgaagacctggtcatttctttactcaaaatgctagaattcatcattccagttttttagtagctttgtgtttggccagatgttttataaagcgtgtttatatgcagtgttttaatctttacttagaatttattaatatgaggattcatgaaattttctctgactttctcatttttaactgagaaccaccttagggtctcattttagaaaatgaggagggagggcatggaggctcatgcctgtaaacccaacactttgggaggctgaggtgggaggattgcttgaggcaggctcagttcaagaccagccctagcaacatagcgagaccctgtctttgcaaaaatcaaataaaaaaaaattagttgggcattgtggcacgtacctgctatgatcacccactgcactctagcctgggtgacagagcgacactgtctcaaaaaaaaaaaaaataaatgaataaataaataaagtggggaatttgtgtgtctgtatccttttctcctttttcttgtgattccctcttttttcttctgagtgtcatatattctcatgtctatttttattttttggcaaataaatgaatactgaaatgagggcctatgataaagggcctcatgatacatagttttttaaaatgtcttgagatttgacttgcctttccttcttatagcttcctaagtaaacagtcagtctgatactgaagtttcaacttataccatgcaagaggccagctgaattcacaataaatgatgaaaaccattttattactatgttctactggaaaatttaatttcctctctggccattaacattgtttactttctcccttatctcctgtagtgcccaatttacagtgatgttccttttggttttagtaaaatcagaaaagcaatgtgatgtagtggaaagggcacaagatttgaaattcagaccaatttgggctagcagattggtccccatttacctcattgtgtagctttaagcaggtcattgacctctctgagcctcagtttccatatctgtgaagtggagatgataaaatacccctttgctgtttcactgccatcatgtgaggaggaaatgagaccatagatgtgaaagccctttgctgtcctccgaagtggttactatactatgatggtgattattatcaaacgagttgctcttttaaatttgtaaagaaaggaccacagctcttccttaaccaccgcagctatctgaagcctctgctgacccacagcgggcctccgctgacaacaacactccctgcctgctgtggacccatcgccaggtgcctcaccagcccccaggcttacgaagtaagttggttttatccaaaactaaattcttcagtaagttaaatttatctgctctgtggatgagtcactggttttattttattttggtttgtttttttgcctttgaggtataaattccatgaaagggaatttaagcatattttgctcaaccagaaaatacactgaaacctataaatataattcacagcctttgaaacagcatttgaaaacagatatagaatcgtgcctcatcttactgtgggtgattttagtaaatagttctatttccctgctggctttcatttctttgcagtatgtgtcctgagctcagcactaaatgtgtatgctttcctccacaaatgagggttgtctcagttacattttgaggattttaaaacaattttgacatccctaaagtgcaacagatggtctattatttcacacctcccaacctttggatgtttgggaaagctatctgcctctgttccacatttctgggacacatgagcatatctagatagaatctgaattccatattttttccttagctaccaaaatgtgattggtaatttgataaatattgctactaagaaaaaaataacagaaatcctagctgacctttgtttttaaatgtgcacgtttttatttttcaagttcttttttaaaaaccttccattctggccaggcgtggtggctcatgcctgtaatcccagcactttgggaggccgaggcggcagatcacctgaggtcaggagttcaagaccagactggtcaacatggcgaaacccagtctctaccaaaattacaaaaattagctgggcacagtggcgtgcacctgtaatcccaactactcgggaggctgaggcaggagaattgcttgaattggggaggtggaggttgtgagcagagatcatgccactgcactccagcctgggtgacagagtgagactctgtatcaaaagaaaaaaaaaagaaaaagaaaaagccttccattctaaacaaacctttcagaaataatctatgacatcatataggctcccctgttaacaaagcccaccagttttgactacttaggtgcaacacgcagaaccttgagaggggaagctgtagtgaagctgtgtagacatgcaccacacacacctccctccccgtgcccccattccctgtgagtgaacctcatgtgaaaccagattgtataagaaatggacaggagagagtaggcagagtaggggtggcatctgggccagggaggagcatcctacggctttgtgttatgtcgtgtcagtgcatgtttctgacagactgtgcctgtgagatggggcacacaccccatgttgcccctcctctcccttccacattgcccaggctcgcctctcaaacattgtctccatttccaccatgccctgttaacccacataactgtgcagagaagtcagccagctctgttggttcaggcagtgaagcttggctcttggattccagagacccactcgctgtcaccaaaagccagaagaggtccacaacaaacctgtgtccttggaatgtagcgaaacacaacaggctccctagagcagctgtaacaaagtaccaaaaccgaatggcttaaacaatagaaacttatcatctcttatttctggaggctaaaatccaaagtcaagttgttggccgggtcagttccttctaggctgtgagggagaatctgctccaggcctctcttctaactcctggtggcttcctggctatcttggaccttccttgacttacagatgcatcactatgtatctctactttcatcttcacatggggttctacctgtgtgcatgcctacttccgtgtccaaatttctcctattcataaggacaccagtcatattgaatcagggcctaccttatttccaaacaagaccctatttccaaacaaggttacattcacaggtgctgggggttaggacttcaacatcttttggtggggggttggggagggacacaatttaacccataacaaccatcacacttaattttttttttttttttagacagagtctcactctgtcacccaggctggagtgcagtggcgcgatcttggctcactgcaacctctacctctcaggttcaagcgattcttatgcctcagcctcccaagtagctgggattacaggtgtgcaccaccacacccagctcatttttctgtattttttagtagagacgaggtttcgccatgtcagccaggctggtcttgaactcctgacctcaagtgatccactcaccttggcctcccaaagtgttgggattacaggcatgagccactgcacctggcccaaacgtaattttttatattatctttgttaactgctttttttagttataacactagcaagctcatggccaaatatccatacagtatggaatgtacaaaatgaaaaatcaaagttgccttcctcctacctgcagtcctcgaggcagtctttattataggctcactgtggatacttcctgatatattttattgcaaataaatatgtgtatatatggctttgttattgttttacacaaatgggattataataggcatattgtcccattacttgctttttttttcaattactgacacatcatggatacctttatatgtgagtatgttagatgtcttaccttctcttttcatggctacgtcctattccatttcatagctgtagcaaaattcatgtattcagtctcttatggatagatgtttcagtcatttccttttttgctattataaacaatacttatagtgaatattcttttacatataaacttacctaactatgtaaaagtatatagaatagattttaaaggtaaaatcactgggtcaaaaggcatgtgcattttaaaatttgatagatattgccccaaacctcaaacttaataaagacactagaaggtgctgaagagcccctgtggacctgtgaaggagccacagagcttgtgagtattgctgaattaagtgatagatactggttagatagacttactgtcctaactagattagacaggaagggatttgggctggttggtggatatgagtttgtttgtttgtttttgagatgggttctggctgtgttgcccaggttggcctcaaacttctgggctcaagcagtcctcctgccttagcctccccagtagctaggacaatagacatgtgccacccatacccagccgtttatttttcagttcacactttttttggtctttgagtatttaggggaatttctagcaacagcagattaaattcctttttagattttgtctaatagtcttctcagtctatttgatggtcttagacaaattcaaaattttcaaacagacatgggatttagaaagctggagaatatacttccctcaaggagcatcaatgacagactgttttatgctagatcaatgtgaatatttagaatgatcctttctctttaaagtcatttagaaaaaatgacttgttctgttttttaaaagtaatatatactcattataataaaatttcagataatacagaaacataaagaagaaaagacttttctatacacacattttttatttgccaatatgggactatgtattcctgattcttttcccttttgtagaaccttatttaagtatactattttggtcgtaatatttccatgagaaccaaagcttatggagctgcagtgagggcttgatatgtttctctgtaccccaaactgtattaggtggttggactacgtagcattcaccctgtgtcttcaccacatgtgaatcggtctgctcctgccacacactagactctaagcctcttgagggcagattgatacacacacagttatagctcaagggtaagtgccactacagggagagggccaagtataggatgccacgaaagcacacaggaaggacagctaacctagtcctagaagctcaaggaagacttcagagcaaaagtgataaaaggatgttagtcatttgaagggaaagaggggtcatgtagaaggacctgaaggtaagagaaagcacgaggagtctgggcagctgtcacacttcagtctggttggcagacaatggggcctttggtgtgggaggggcagattgtagcaggagaggaactaaggatgccaagtcacgctgtattttaagccaaggtatggactttagactttatcctgagggcagtgggctaccacttaagggttttaatgggggatcctcgaaaatactcctattggaaatgtctcttgaacttctcaaaaattcttaaatcttactttatttgcatttagaaccaggaacagttgaaagatgatgattctgatcttattctcaatgatggtgacatcagtttgacatatggagattctactgtgaacactgaaccggccacatccagcgccccaaggagatttatgggaaacagttctgaagatgccttggatcgggagcttgcatttggggaccatgaactggtcattcgaggaacacgcctggttcttccaatggatgattctgaacccccgctaaatttgttagataatacgagacatggtccagcctaagcttactaatactcacttagtgatttgtaaaatttgcacatgtgattgtgaagaaatttgtactacctaaaagtcccagtgcatgtctctgaatgtgtaagctatataaatgctatttatatggcatagaaagaatataaatatcctgtacacggcagattgtgaacaaactatattcctttaagttttcctggttgcactctgtagactggatctgttttaggaagttactttcacagtgatgttgtgtgttctgttagttttatgtctcagttaaagtgtaaaaagtgacggattttctctttcttaaacttacctgacacttaaccagagtaccagttctcgtgatgtgaattaatttttttgtgtgctaggggagggagagtgaggagggagtgttatttccttgggaacctagggaggagaggttcctttgttgggaaacttttgttgatagctgctgcctttgtcctgatcgttttctttcccttttctctggtggcctgttgtggtgcaacgagctgatggcatttgatcttgccccattcaggttggggagtgaagtgtgaggacccttttcccccgcttgctgtgaaagcacagattcattgactacagtacactgttgttcagaaaagaaggctgcaaatgacttctgagactttatgtcttttcttccagaccaagaccgtagaaggagtcacatctagccggcttagccaaagtacaggtgtatatagttcagggcacttgatttagatttggaggggctggggtgggcagagagcaagaggcgagtaaagagaatggtggtttcagagatctctcttcccaaatgtgtaaatattctataccagataagtttaaataagaaatttaattgctgcttaatttttgattatgtactttatctgtatagcaggctttgtcgtcagaagtttttatatcgatttaaattgctgctctttagcagccaaacaggagcaaaatgtaaaatttttgaacttactgtgtctaatcatcatttgttagtctgtagttaatgtcaacagttaatttatgaacccacgatcgttccacactgcaccaaagtcagtcataagagaaatcgaatattctggagcactgattgcagcagggtggctcctttgtgtgcagcaggtgtagtagtcttcattttcatggtacgttttaatattaattacctaagctgccatgcatttttttttttacagttctcaaggaagagcacagaacaatttctcatttcatatttggagtatgaaagtagattctattttgtaatgctgataatacctaaagatgcattgaatgcttggaagaatgctttttgatgttgattttgacctgttcatgattcagaagaaaaacaaacttttttggattttttttccctcaggtctgagtagcattgccttaaatcttatccagttagaacattgatttatttacatgatgttcagattttccagtgaaaaatacccttctgaacaaaacatgtacttactctccgaaaggcatctatctgtgctattgcaaacactccttgagattttaggggaattctaatgttgtaccctttcgtggcagctttgactgttggcatagccatttgttatgtagtggtagcgactttcctgctatgcaggaatccctcccatgacgtgtatgttttacatgatgtgtgcctcttcacgcagtaaatagtttcttgttaatgtatgtttgaggagtttgaacgtcagtgtcacttacccacaaagttattcaagttgtaaaaggttatacaataatttaacaactaccttttttattctgtcgggttactgacctcactttatgtaaatacttcgcatgacaaattcagtaactcgtctatttcagcatgcataagacttttcactagggaaactgataaagcttgagtcaactaaatctgccttcatactttatcaaggggaaccaagcctgctgtgcttacatcagcatctggaagactttcctctcctctaatctgtgtacacatctccaagcaaggaagaaaaaacaaactctgctcagacgcctatgaaacacctgaatgaactttgatgaagtacagtctgagttaccatcatgcacaagtagaactgctcttggacttgttttcctgttgtttgtggaacctacgcgtttgaatggcttgaacgttgcatcttttaaagttattttttaaggtttcttggcatttatcctagttgtccgtgtttggcaatgtgctgttaaagtaatagacttttaatctttatgtattttttgttttctctggagtacttggacagatgttatagtggtttcttttaggaaaatctgtcattaaaaaagttatagccttgcaaataaccactcacagtatttgagtcacagtttattttagtgagacgtaaagagtgctgacttcatttatttttctacctatatacctagtggaaaaggggaagactaatgttttcaaataaacaaacagaaacctaacagaa

SEQ ID NO: 18 - DNA, 23071 bp, Homo sapiens
agtacgcgtgggatttggctccgaggaggcggaagtgcagcacagaaagggggtccgtgggggacggtagaagcctggaggaggagcttgagtccagccactgtctgggtactgccagccatcgggcccaggtctctggggttgtcttaccgcagtgagtaccacgcggtactacagagaccggctgcccgtgtgcccggcaggtggagccgcccgcatcagcggcctcggggaatggaagcggagaacgcgggcaggtaataccggggccagcgccgcccctcccttgcgcccctcactgctgggcaggctggctggcgcgcgcgcgcgcacgcaggggtcttttaaatcccggccggaatacaaaggccggggccgcgcgtgcgcactgtggcctggtcggcctttccttccctggctgcggcggtggtggtggaggtcggggctgctctgagggttacctggtgcacctggacccttctttggttccccgcgataaccagttgactataaaatatattagtaagcattcagcagtctttggttaatgtgtctttctggatgccattcttggctagaagggttttccgtcaccctccattaccacgcagagagctgtaaagatgagtgtcgaacatttccagctccaggagttttcattttaaagttggttgatttgttgcggcttccccccaccccaaaggcctactgaaagcaactttaagggtcacgggttagataattttgttgtgggcatatgtatacactctcgagtagtcaatctaaaaatgacctttgagttttccagtggccttggggacgatcttaagaatccgtttttaaaaagtcctttgggggagtcaagagaaaaatttgcaaaagcaggagatttagggacttgaactcctggcggaagactaaatttttaaaaaatggatatggtgacagttttttaaaagataaagagtgatgatttacattgaaattaaaaggaaaaaaacctatgcctaatgaagaattatcctgactctcagtggctaatgggagctgaatttaggcaatacaagggacttatatgggcctgttcatgtctgtaaagttggcatgtctggaatctgattctgacatgccgagaattggtgttacatgaaagggcacactaaccaaaataaattagagcttaggaaaagagatatatgtagacaaagtgtggactttatcttgactttgtggatcaagtcctggaataaattactccacttctttcccagaagaactttacaaataagagaattcaccagaatttgtggaaatctctctctcataacctcacttaagagcagaattgaaacttgggccaagaataaattacacattgtaagactttattcagggtcttacagcaaaatagtaggacttcaatacactgtttagctcaaagctgtgatatgtcggcctgacttcatccaaaaggctatagaccagattttattttgccttgaaaagctttcaccttcaggaactgtggaaaattctgtgtaatcttctgaaatgactcagaccccaggtaatccttaagagagtagttctctgtcacccttgactgtgctaatcaagaaatgtaatgtgggatgtgaaaaaaaataaatttactttttttttttttttttttgagacagagccttgctctgttgcccaggctggagtgcagtggcggatcttggctcactgcaacctccatcacccgggttcaagcgattctcccgctgcagcctcccaagtagctgggattacaggcacctgccaccaggcctggctaatttttgtatttttagtagagacagggtttcaccatgttggccaggctggtcttgaactcttgccctcaagtgatccacctgcctcggcctcccaaagtgctaggattacaaatgtgagccaccgggcccagccgacttttttagaagactaatttcagatattcaaagaagaaaattcaaattccatgaatacagacttttttttttgtttttttttttttttgagacagagtttcactctgttgcccaagatggagtacagtggtgcgatcaccgttcactgcaacctctgcttcccgagtttaagcgattctcatgcctcagcctcccaagcatctgggactacaggtacccaacaccacgcccagctaattttttgtatatttagcagagacgaggtttcaccattttggccaggcgggtcttgaactcctggcttcaagtgatcactttggcctcccaaagtgctgggattacaagcatgagccaaagcgcccagcctagactttatttcaatggcaaaatagttcaggagtcttagaaagtgcttacagtcaatcaaccagagaggaataaaggaggaattttctaagggtactggggagtttcccgtgacctcaggcgtgaaaaagacatttaccgaagatggaaaataggatgccaaatcaaaagtaactggaagagagtagcatggaccactaagaataccaacaggaaagattaacccttgcatgagagtagactttatagaaatgttaaggagaccaggaaggactgttttggttagatgttgacaacaagaagaataaaaaagatttgggttttctccccagtctactggcatggtggcagcagacaacagaacacctaagtactttgttctgatttggattttacatctcctatgttagcaaaatgattgtctgactggaaatggcagaatgaatatctgtaagacttaaagctcaagaccagtgaaggcatttaggagaagtttcaggtgttctaacagaatcatatgccttggcctgcgtgtgttgtgtttcaagggagaggccagattaaagcagtgttagaggatttgtagcaaatgtaagggacctggaaataaacacgtgggttcctgttcttccagaggtggagtctgtcctctgttgacattgatcctgaacaaaatttttacttaatcaatggttactgagcatttttaaaagaaactaattgaccgggcacagtggctgacgcctgtaatcccagcactttgggaggccaaggcaagtggatcacctgaagtcaggagttcaagaccagcctggccaatatggtgaaaccccgtctctactaaaaatacaaaattagctgggcatggtggcataactagtgaccactacactacagtatcagttcagaaagaaagcaagacctatactagacaggcagcatcagaaggatgctggcaggaggtacctacagtagtcattattatagcaaatttattatataccaggtactgttttggatgttttacataggccaactagcttaatgctcctaaccaattattaggtactattcccattttacagatgtggaagcatgggcataaagagattaaggaacttgcccacagagctagtaaatgggagagctgaaatttgaatccagatgacctagcttcaaagtctgcttctctagctagcaaatgtgctttactgcctctcttagtgagcaagatggagatggactgatggcaatccagttaggtgaaataaaaacctgacttactactgaaagaatcaggcagactgaagagaggtctgtacttatatgccatgtatctctatccctaactttgttcctttcagtaccttaacgtcagggtgctgatggcatggtgataaaatttgtgagtgacccaagcctgggaggaatttgtggaattaactgattgatttaatcagagtccagataaatcctgactgactggaatggtgaatcatcttttacaaagaagaggcacaatcctatactcagctgcagaaaaatcagtgataaagtgtggaatgagggagaagtgatacaaggacagtgttcgttgatgggaaactcagtgtgaatcaacagtataatgtgggtgccagtatagctagtgtcatgggttctgcagtttgtctccaaaatgagcaagttggtagccctgctcattttcgggctgatgaggctttatctggagttttgtttgattccgagcaccaaaaaatgaagaaatttgaaatcatactacatgaggaattatactatttgaggaatactgtatgaggactggcttattctaaatctttatatttacagtttctagtagactgtacatatggtgaatacacagacctccatctagcaataccaaatggaataatagttatggtgctatcgcatcataatttacataaccagacccctttagttgagcatttggattatttagccttgttcattattttgtaagtattcagtatggtatatgctttttttaagtgaagataataaaatgtatttagaaaatagcaacttaggctgggtgcagtggctcacacctgtaatcccagcactttgggaggccaaggtgggaggatcacttgagaccagaagttcaagactagcctgggcaacatagtgaagccccatctctacaaaaaatttaaaatttagccaggcatagatgcatgtacctgtagtcccagctgctcaggagactgaggtgagaggattgtctgagcccaggtgtgtgtggttactgtgagctatgatagcaccactgcactccagcctgggtggcagccagaccctgtctcttaaaaaagaaaaaagcaacttaaatccctaaaatagtgtaaaataattgaagataaaagaagttggagtcattaattttagagaaaaccttaaaaatttagttttttgaaatacagcaaatctagctaggcatggtggtgtgtgcctgtagtcctagctactcaggaggctgaggcaggaggatcacttgagcccaggagttggaggctgcagccaactatgatcatgccactgcactccagcatgggtgacagagtgagaccccatctcttaaaaaaaaaataattaaaaaaataaaaaaatagcaaatctgaattaactggacttcttaatgaactctatgcgtggagtgtgtgtatgtgtgttttgagaaagactatcagaaaatatagtcgaccttccatatctatggattctgcatctaagaattcaaccaactgtggattgaaattatttgggaaaaaaaaagacaaataacaacattaaaaaatgatacagataaaaagaatgcaggatgacagctacttacatagcatttacattgtattaggtattataaataatgtaaagattatctaaagtatatgggaggatctgcataggttatatacaaatactatgccattttatatcaagcgacttgagcatccttagatattggtgtctgtgaggggttctacaaccagtcccccatgtatgcaaaactaggtacataccacagtccatttttagaaagattgattagtaactaaaggatgactgtacacaattcatcagttccaggcagctataagaaaacaatctagccggacacagtggctcacacctgtaatcccagcactttggggaagctaaggcgggcagatcgtgaggtcaggagtttgacaccagcctgaccaacatggtgaaaccctgtctctactaaaaatacaaaaattagcccggtgtaggtgcctgtaatcccagctactcaggaggctgaggcaggagaatcacttgaacccaggaggcagaggttgcagtgagccgagatcatgccattgcactccagcctgggtgacagagcgagactctgtctcaaaaaccaaacaaacaaaaaacaacagaaaaacaatctatgagcgctgcagttcaacagaaggtaagtgcaaatggaggctagcagagaaaaaggggtaaacaggaaaatgagggagagtgagaggtagtgaagaatatttgagactaagataaatgatgggggaagaaaagtgaacgaagagaaataaaatcaatcgtgcttgtaagtttaacatcaggaagttatacaaagtagaaagtctttggggtctgttttgagtctagacagatctagtcctatttcctatacattgtccacatatgtagaaatcactgaatctaattcctcattttcatggtgagggaatggataccccgagaggataaatgactaaatgctctttgttactgtccttctcatagagttattgctcagaaacattgcagagttctggattataaagtagcaacgatcattatgcatacacaaatgtatttaagaaatatcctcacactgaggttgaaacaggtttatgctgcttatacatttagttgttattataatagaagataaaattatccagaaccccccttttttttttagacagagtcttgctctgtcgcccaggctggagtacagtggtacgatcttggcttactgcagcctccgcctccctagttcaagcaattctcctgcctcagccttccctgtatttaggattacaggcgcatgccacgacgcctgactaagttttgtatttttagtagagatggggtttcaccatgttggccaggccggtctcgaactcctaacctcgtgatccaaccccctcggcctcccaaagtgctgggattacaggcgtgagccactgtttccggccagttatccagaactgtttagttaactagcattcaagtttatgaagatttttgtgtagatgtaatgcttgcttctgccaaggaataagaatgttgtaatccaccatcttttattctggcttttaggcagctgttgaggtaaacaaactaagtttaatgctcgaagatagtgtattcctcagaactaacacatttgattttccataggtttattttcctttacctgttctaatttaactttttgtaaaatgccacagtccatttttagaaagattaagggatatttcattattatagataagtttctaggtttctttcaaacttgatatacctaatataaaagttcagattatttttcctctttatttttcactttttattcagccaactgtgatttctagaattttgattttcagcttctgaaccccagaatttctgaagatgattaatgacctccgactatactaaaagttttgaaaaatttttttaaagtaaagaatcctgttgtaatgtgaacggtgtctccctaatttatgtattttcagtttgcattttcatgaagtgctcaaaatgggacatgtgaaattctgagagtagtagtaagaaacatgggagagtggtaggtagattgccttcctgaccatgtgacagagtaaaaacacgtttcatacatttttttttttttttgagacggagtttcgctcttgttgtccaggctggagtgcaatggcatcatctcggctcaccacaacctccacctcctgggttcaagcgattctcctacctcagcatcctgaactagctgggattacaggcatgcgccaccacacccagctaattttgtgtttttagtagagacagggtttctgcatgttggtcgggctggtcttgaactcctgacctcaggtgatccgcccgccttgacctcccaaagcgccgagattacaggcgtgagccactgcacccagccacatctcatgcattcttttgctcgctcatttattgtcaccatatgcctttgtttctatatattcaagctaaatcaaggtgctattagaatctcgggaagctgccgctgaccacagtcagaacttgcagtttctttagttagaattgccataggaccactgctcaagacttccagatctaacctagccatatccaactcatcattagaatatttaaatcatgaatgttgaacaaccaatattttaacaatttattgcatagagctactaataatattaaataaaactatggaaaaaaaggacattttactttgtgccaggtatgcttctaagcatagttctacatcttaacttctagtccctgtctacatattttcccttatgtgtagccttagttatactattttgtattcttttctgttttaaaatatatataaactctttcctgttcttttacataagataaataaacttaattttttagctgcatagtattttctcatgttaatgtattgtagtttactaagtcataactttatttttatttaatttgtgaacaataaaagaaataaaactcttatgatacaggttaatctctttctcactcattcttaatctttgctttaccaacctacccttaaagatagctggaagtggaaatgcctctccagtggtttgtccattgggattgggcttctgtttatcttgagctgccaacatttagcccagccgctgggggtggtctgttatcctttgtttccccaggccatttaagcttatccaggaaatgctttagtttgccttttttttttcctgttaaccattttattgagatatgatttacatactacatagttcatccatttaaagtgtactcatttgccctcttttgttgttgttgttgttgttattgaggcagagtctcgttctgtcccccaggctggggtgcagcagtgtgatcatcgctcactgtaaccttgaactcctagactcaggcaatcctcctgcctcaccctcctgagcagctggggctgtcagcatgtaccaccatgcccagctaatgttttaaaatttttttgtggaggtggcgatcttgctatattgccccggccactcttgaattcctggcctcaagtgatcctcccgccttgccctcccaaagcactaggattacagacataagccaccgtgcctggcctcatttccctttttaatctgctttctgagcttcctgttctctttcaatgaatatcatagagaatgaaaactgattagtatagtatcttgcagtagaaaacatgactttcgctgggcgcggtggctcatgcctataatcccagcactttgggaggctgaggcgggtggatcgcgaggtcaggagattgagaccatcctggctaacacggtgaaaccctgtctctactaaaaatataaaaaaaaattagctgggtgtggtggtgggggcgcctgtagtcccagctactcgggaggctgaggcaggagaatggcgtgaacccgggaggcggagcttgcagtgagccaagatcgcgccaccacactccagcctgggcgacagggcgagactccgtctcaaaaaaaaaaaaaaaaaaagaaaaagaaaaagaaaacatgactttcctctccaaatagtaaagcaaacttttccattttattttctactgtttttcttctcctgcctatttaatggcattatttggcatttgctgtaacttgagtttcatcaaatatgtgtttacttctctggttttatgctaacagcaacaccatgagatagtggtttaaggccatgagaagtattttttttaattgttttctttgaaagcccacattgtttcctttgaacagaatactttgaacaaaatttaaatcgtgttcagaagagaggtttagaggttttttccttcataaattcaacacatgtttacaaaatatccatttcatgtttctctttagtgactgaatctattttgtgttgctgtttcagaatgccatagactgggcaattaataaacagtagaggtttttttggctcctacttctggagcctgggaagtccaagatggaggggctacatctgatgaggggcttcttgctgcgtcataaaatggcagaaggaatcacacagtgaggcagcacttgtgacagagagataggaaagggagttgaactcatccactcatcgtgttatcaggaaccctctcctgtgataatagcattaacccactcctgaaggcagagccctcctcttgacctaatcaccattttttttttcttttgagacagaatcttgctctgtcacccaggctggagtgcagtggtacaatctcagctcacttaaacctccaccttccaggctcaaacagttctcctgcctcagcctcccaagtatctgggacttcaggtgcatgccactgtgcccggctaatttttatatttttagtagaggcggggttttgccatgttggtcaggctggttataaactcctgacctcaggtgatctaccctcctcggcctcccaaagtgctgggtttacaggtgtgagccactgtgcccggccttgtcacctcataaaggtcctacctctcaacacttgcattggggatttagttttcaacacgtgaactttgggggacacattcaaaccatagcagtggcaaaaaaaaaaagccctagccccaacaaaacaaaaataccaccatcaataaaaatcaaatataggcctgggtgcagtggctcacatctgtaatcctagcacttggggaaactgagatgggcagatctcttgagctcagaagttcaagaccagcctggccaacatggcaaaaccctgtctagacaaaaattacaaaaattagccaggcattggggctcgctcctgtagtcccagctacttgggaggctgaggtgggaggatcacttgagatctcccacctcagaagtaacagtgaaccaagatcacactactgcactccaacctgggtgacagagggagaccctgtctccccacacacacacacacacacacacacacaaactaatgaaaaaataagtaaacaggcaaataaaaataaactaaaagagaatcttaattagattggaggggatcttcaggtgattaaatactgaaggaaagtaggggcacaaattgtatttggggacatcttaaccctgtatgggttgatagacctttcaagtctgtctactagaaaactccctcaaatcttatttcagagaaagtatgggctgacttgacaggactgatcagttttatcagtgacacatcttatcatttaaacagtgcaagagttaatggttggttattaagcactcagtaaaggttggtgaacatgtacatacaggactagatctctcctctgtaatccactctaaataaatacttcagtctggttacaaaatacttaatactgtactgaagatttttgtacagctgatcatttggatttacatttgggtaattttatcattacatctcatgcttcattattctttcagctattcccttcagcaagctcaagctttttatacgtttccatttcaacaactgatggctgaagctcctaatatggcagttgtgaatgaacagcaaatgccagaagaagttccagccccagctcctgctcaggaaccagtgcaaggtagtttcaccatgagagcttagaaagttcaacatcggatcagccagcttatttgagaaagggtttcatggtgaattttagctctattttagtgttaaaaagtcaaatccactttttaagtacttagtatgtgctaagcactgataggttctggggaataaaagaacatgggtcctgcccaaaaatatctcataatctagtagagaaaagtaataagtaaatacacgttacagctcagcacagtttgtagtgaagaggggcatagaatgaatgccctgaaagcttatggggttggcttctaactcagactgatggctcagaggctgcttcccagagcagagaaataacaccagggctctgaaactccaacaatgtggaggcttcatcccgataaagatcagagtagggacatgtccaggctgagggagctatacaggctgggtacagacacacacaagcatggcatggccagaaacagagcaattctgtgtccttggagtctgggatataacaaggaaatggtgagaggtgaggctggatggggacagttgaaacttgttttttaatcccaaagaatttatattctatcatgaaggcaatagggagctgttgagagaatgtaagcaagggatgacttacttgactggtgctttacaaattagcctggaaatattagagaagatagattggttggtagacaacaagtcggaacttggaggcaggccgggcacagtggctcatacctgtaatccctgcactttggaaggctgaggcgggtagatcacctgaggtcaggagttcatgaccagcctggcgaacatggcaaaaccctgcctcacacaaattagccgggcatggtggcgcacacctgtgattccagctactggggaggctgaggcacgagaattgcttgaatcctggaggcggaggctgagaggctgcagtgagccaagattgcaccactgcactccagctgggcaatagtgcgagactctgtctcaaaaacaaaaacaaaaacaaaaacaaaaacaaaacttggagtcaaggagtggattagatggattagagacactgtttgaataatctaggggagcactgaggaggacctgaaggggtggagaaagaattaggaaacacttaggaggtagaattacctagccatggctaatgggtttcatgtgtttggggggagcatggcaggatagtgggggagaaaggggagtccagaagtaactaccaggtttctggcattggcatttggttggaggaggtgccactcaccaagacagagaattagaagaaaataataggttccaggggtgggagagtggttggagagaagttaatgattttctccagtgtaacagtattttatgagaaatgtgctcagggttttggtttatgattgcaggaacacatctaataactctgcctccgcattaggacttccccagctacatgccagtgatggtggatctgttggcatagggagtggctaagacaatgtgaggcagaagagaggagggactgactgcctgtatcctgcgaggcttgattggggaaacgccaaagaggagtagaatagggtagaagcctgagtagttaggagaaatgttaaataattaagggtaagaaaatcagggcttcctgttgggtaactataggtcagtggttttcaatcaagggtgattttgccctcccaagggacatttgacattgtctgaagacacttttgatgatcaagactggcaggttactactggcatctagtgggtagagatcaggggtgctattaaacattctgtaatgtgcagtacagccacccacaacaaaaaattatgcaacctaaaatgtcaatagtgtggaggctgagaaactgctttacgtcctgaggttggatccctcctcttgccttttgaaaaatactgccagcccagagatgtcatcctgggcacccctaaattcccctcttcaactatgtatggaacagaatatacacctcatctctaaaacaagcccacaagccattgtgtttttcttttttctttcttttttttttttggacagagtcttgctctgttgcccaggctggaatgcagaggcatgatctcagctcactgcaacctccacctcttgggttcaagcaattctcctgcctcagcttcccgagtagttggaattacaggtgcacgacaccatgcctggctaatttttgtatttttagtaaagacgggggtttcaccatgttggccaggctggtcttgaactcctgacgtcaggtgatctgcctgccttggcctcccaaagtgctgggattacagacatgagccaccatacctggcccatttgtggttttctactggggaagttgagttaaaatgtttcccttccttcctgtttctctatttttctgttcttatttaattatttatgtatttacatttagaatttatataaaatgatatgtagatactttgtatccttgaggaggttaagatgccaagtaatactgtgtcgaaaataatagtctatgattattcttcccacgaacagctagcaggggaaggagagtggcatggggggttgcacgaacccagttctagggagaaagaaagggaagatattgcagaggagactcatgttgggactgtaagagcttaattttggggagacaggtacaaaaggtgctagttgggtaacttttctgggaaagctgctaaagtttctaagttaagattttctgcatttctggaaattatttgtatttcagaggctccaaaaggaagaaaaagaaaacccagaacaacagaaccaaaacaaccagtggaacccaaaaaacctgttgagtcaaaaaaatctggcaagtctgcaaaatcaaaagaaaaacaagaaaaaattacagacacatttaaagtaaaaagaaaagtagaccgttttaatggtgtttcagaagctgaacttctgaccaagactctccccgatattttgaccttcaatctggacattgtcattgtaagatctttgtcctcgttggattttataagtagtattgggggatcagctttacttaacagttgtccttgcaaatagcattttgctgaaaaggaccatttctaagaatccttttggtggtaaatggtgtcagcttcatgaggttgtgttatatgagagtgtttaagagggtgggctccaaatttagactgtctgggttcaaatcctgtcacaagtataatcttggataagtcttattaacctttctaaacaccggttttctcattgataaaccaggggtgataataccaccccccgatagggttgcaagtaaatgagagaatccatgtgaatcacttcaactgaatgatgcctgtggagacctgatacatggcagcactaattttaagctcttatttttctcagtaactgtaagaaacatcagcatgtgaacaattgtgtaggtgatgtggagcgagcttcttgttgaaagttgagaatcagaattgtggctggacatgggctcagattgattgttccaggacctgtctttccagactcaaagcagcccagttggtgagggtgcgaggcctgggatcataaaggagtcaaactggttttttaaaataacagcaaaacttttaaaataaagaaaatctctttcccatatatgaaatactttgttcagatcaagagtagtaattgataaatgatattgcttatgatgctgaattaaatttgtattttaatcaactcaattttgtccaccactcctccatagaaacgctaaggcttaggtcctgctttttaagatgaaatgtctaattgttttgttttatagattggcataaacccgggactaatggctgcttacaaagggcatcattaccctggacctggaaaccatttttgtaagtggttaccttttaaattaatttacttttaaattaggtatctttgttaacaggttttttcagaaaaaccaattgtgtttttaaaaagaaagagactgtaaatacacattcgtgtttcatgttctgtgtgtgtgtctgtacgtgaaaataagagagtttgaaatgatatgttactgttaacattttagtctatgagaatggagggatgtgaataagagtactttctcttttgtttgaattgtttctaatgagttgtactacttttttttttttttttttttttttttgagatggagtttcgctctttttgcgcagactggagtgcaatggcgcgatctcggctcaccacaatctccacctcccaggttcaagtgattctcctgcctcagcctccctagtagctgggattacaggcatgtaccaccacgcctggttaattttgtatttttagtagagacggggtgtctccatgttggtcaggctggtctcgaactcccggcctcaggtgatctgcccacctcagcctcccaaagtgctgggattacaggcgtgagctacaacgcccagccaagttgtattactttttaaaaatgattttttaaaagttgttatctataggcatagtaacgatagtatagtacatctttgtggcagtgcagacataatactaactttcccagatttctggtgattattttctagcagagcataaaatagtagtaaagactcatatttttagagtaagttttaaaaccaagtgttggctggatctggtggctcacacctgtaatcccaacactttgggaggccaaagcaggaggatcacttgaggccaggagtttgagactagcctgtacaacataccaagatctcatttctacaaaaaaataaataaaaaattagctgagtgctgtggtgcacacctgtagttccagctactacggaggctgggttgggaaaattgcttgagcctgagaggttgaggctgcagttagccataattactccactgcactccagcctaggtgacagaactagaccctgtatcacaaaaacaaacaagaaaacaaacaaaaaacaagcgtaactactgttgcattgccttctctatataagttgtcttgtatataaatcatcttattttatactgcctaatagatcagtgtatgcagtatacgctcaggaaattgattatctaatagtaacattcaaaacatttagggcaactgatagtaatgtggttttggaactaataataacatattgtccctattattttaaaaaattcctttttaagggaagtttggacttttgactttcttcactgtcaaggtgtttgaatgttgttagtctagtgctgtatgtttacgtgtgaggtggtggtatcaccaattgtaaagcaaaatagtctcaaagtttcctaaactgagttgctatatattcttgggcaggcatttgcctcaaccccctgtgaaaaggagataataatagtatcttgcaagataattatgatgattaaatccaagcgctgtggctcacacctgtaatcccagcaattttggaggctgaggtgggaagatcacttgagcccaggaattcaagaccagcctgggcaacatggtgaaaccctgtctacaaacaatacaaaaattagctgggcgtggtggtgtgcatctggggttccagccactcaggaggctgaagtgggaggattgcttgagcctcggtggtcgaggctgcactgagccatgatcgtgccactacactctagcctgggtgacagagcgagaccctgtctaaaaaaaaataaataactgaattttcattttacagggaagtgtttgtttatgtcagggctcagtgaggtccagctgaaccatatggatgatcacactctaccagggaagtatggtattggatttaccaacatggtggaaaggaccacgcccggcagcaaagatctctccaggtaagtacacagcatttgcttttatgggttggaaccttgagtatgctggtgccccaaatattctaggaacatcatatgtatctagttcaagctgagctcaacaaatgtacaatatgctctttcattgaaagctgtctgaatttagcatattataaatattgtcatatttatatttttgactactttttaattcaattttagtaaagaatttcgtgaaggaggacgtattctagtacagaaattacagaaatatcagccacgaatagcagtgtttaatggaaaatgtaagatttacttttaaattttttttttctttgctaacattatgggcaatgtaaatatgtttgtatttcattttaggtatttatgaaatttttagtaaagaagtttttggagtaaaggttaagaacttggaatttgggcttcagccccataagattccagacacagaaactgtaagtccctaaaattgaatttgtaaatcagctaaatgtgaatttttttctagataatttccttatttgtcctatccattgtgatttataccatgcaaaacaattacactgtattttgttgaataatacctatacatcagctttaactaatagttgtaaattaattcaaatactattagggtttattagaaagaaaaacatttgtcagctaaatgtcttgatgttgttattcagtgaaaatattgagaggaactggctcatatactacattcagaatacatttaatggcatgtagttgtcaaattcaaatggtttagccctcgtactgttgtgaaacaaacatggaaacacagacatgatcctgattaggaaaaccagttgccccatttatatatcttagctcaacttcattttagagccatataaataatacaacccagacaagcctccagccaacctaactggcattcaatactgttgtcttatacacaaagtcatcatgaaataacagtgtttttcaaattgtcctctctacagagcttctgcaggcatttggttccaattttgcttcttagttttaggttttatttacaacttttaaagaacaacacagtgcacagatttacatgttgtatatacaacatcttaactgatggagaagctaatttgctgccaggtttttgtggaaacctaaaaatgtttctgccacctaaatatatttaaatttctcctttaaaattgtttttgttcataatttcttataaatatgcaattgatgagttttattatagcattggtttttgcttaaataaaggcccacctttgtctgcttggttaaaatggtacaaattcactacctgtagtgaattgtagagaaattcctgtagagtactgtgtcattctctgttacatgccatttggaggccgggcgtggtggctcatgcctataatcccagcactttgggaggccgaggcaggcggatcacctgaggttaggagttcgagaccagcctggccaacatggtgaaaccccatctccactaaaaaatacaaaaattagccaggcatggtggcatgcgctgtaatcccagctacgtaggaggctgaggcagaagaatcgcttgaacccaggaggcagctcattaggcggaggctcattatttttcacttcctgacttggtaataagtcagtattacaaattcaaccttaaaagcaactacttttattgatttttacatatatttatatgtagttaagtatcaagttattaacccaaataaagacaaatattctaatctcaatgagtgaattcaatagaattataagatttctgaaattataaaatgttgtgattctagctctgctatgttatgccatcatccagtgcaagatgtgctcagtttcctcgagcccaagacaaagttcattactacataaaactgaaggacttaagagatcagttgaaaggcattgaacgaaatatggacgttcaagaggtgcaatatacatttgacctacagcttgcccaaggtatgttactgtcctcattccttttattcattttgtgtgtgtatatatacacatatatacttacatatatatacacatatacatatatacatatacacatatacatatgtgtgcacatatatgcacacgtgtatatatacatgtgtatatatacatatatacacataagtatgtatgtctatatacatatatgtgtgtatacacttgtgtgcgtatacatatgtgtgtgtctatatatagacacatacacacacacacacacacacacacacacacacacacacacacattacagaaagtatcttatggatttaaaagcaggaaaaaagaaaacaattatattcgcagccagagtgctctgataatgaatattagtcactgttaaaatctccttttaccaaggtcttccctctactctggcacttctgcagataattcacctgcagagtgccagagcagagggatgtaagaaatattgtaccctacgtaaagttgaatgtaagcggtttttacagttcttatgtgtttatttagtacatgctataagtttaaaagattaatagagatgtatctcagtgtatatgaatattcaagaaaaagaattgttcatgatttctgaataaagctacttttaaaattgttgtacaaaatcagatttaaatcctttttaccttcctcacagaggatgcaaagaagatggctgttaaggaagaaaaatatgatccaggttatgaggcagcatatggtggtgcttacggagaaaatccatgcagcagtgaaccttgtggcttctcttcaaatgggctaagtatggttccctccacatgtgtattcctttcaaagacggtttggtcaggattggggggaaaattttaatagaaggagagtaaattattgaagaatgggaatgataatatgaaattttatttagtgactaatagtgaaaaattgatggttatttcacgttgaattacacagacttttacagtacattttcttttttgtttgtttgtttttgagacagattctcgctgtgtcacccaggctagagtgcagtggctcgatcttggctcactgcaagctccccctcctgggttcacaccattctcctgcctcagcctcccgagtagctgggactacaggcatccgccacgatgcctggctaattttttttgtatttttaatagagacagggtttcaccgtgttagccaggttggtctcgatctcctgacctcgtgatctgcccaccttggcctccaaaagtgctgggattacaggcatgagccaccgcacccggcctacagtgcattttctttaagtcatgaactctaggccatcctagttgcattttcctcctttaataacaaatgagtcctgtatctgaagaacagaaacttaacagttgtattccggaagcttgcttaactattttaataataattctccttcactagactgttaaaatctcctactttgatcatttaaaacttccaggccgggcatggtggttcacgcctgtaatcccagcagtttgagaggctgaggtgggtggatcatttgaggtcaggagttcgagaccagcctggccaacatggtgaaaccccatctctactaaaatatacaaaaattagcatggtggcaggtataatcctagctacttgggaggctgaggcaggagtatcattatatataatatatatgcctctcctcgatcccgggaggcagaggctgtagtgagccgaaatcacaccactggactccagcctgggtgacagaatgagacaccgtctcaaaaagaaaaaaaaaaacttcaaataagctgatacggtggctcacacctgtaatcccagtgctttgagaggctaggatgggaggatcactcaagcccaggagtttgaggctgcaaagagctgtgatcatgccactgcattccagcctgggcgatagagtaagacccagtctctactttaaaaaaagcaaatatttctaaatggcataaactaactttgtttttcttttctggcagttgagagcgtggagttaagaggagaatcagctttcagtggcattcctaatgggcagtggatgacccagtcatttacagaccaaattccttcctttagtaatcactgtggaacacaagaacaggaagaagaaagccatgcttaagaatggtgcttctcagctctgcttaaatgctgcagttttaatgcagttgtcaacaagtagaacctcagtttgctaactgaagtgttttattagtattttactctagtggtgtaattgtaatgtagaacagttgtgtggtagtgtgaaccgtatgaacctaagtagtttggaagaaaaagtagggtttttgtatactagcttttgtatttgaattaattatcattccagctttttatatactatatttcatttatgaagaaattgattttcttttgggagtcacttttaatctgtaattttaaaatacaagtctgaatatttatagttgattcttaactgcataaacctagatataccattatcccttttatacctaagaagggcatgctaataattaccactgtcaaagaggcaaaggtgttgatttttgtatatgaagttaagcctcagtggagtctcatttgttagtttttagtggtaactaagggtaaactcagggttccctgagctatatgcacactcagacctctttgctttaccagtggtgtttgtgagttgctcagtagtaaaaactggcccttacctgacagagccctggctttgacctgctcagccctgtgtgttaatcctctagtagccaattaactactctggggtggcaggttccagagaatgcagtagaccttttgccactcatctgtgttttacttgagacatgtaaatatgatagggaaggaactgaatttctccattcatatttataaccattctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaa

SEQ ID NO: 19 - DNA, 24 bp, Artificial Sequence
  Primer
ttttttaggtgggtgttggtagtt

SEQ ID NO: 20 - DNA, 25 bp, Artificial Sequence
  Primer
aattcccctaatccaataaaattcc

SEQ ID NO: 21 - DNA, 30 bp, Artificial Sequence
  Primer
attggataaaggtatagttgttaaaagaag

SEQ ID NO: 22 - DNA, 25 bp, Artificial Sequence
  Primer
aacaatcacaatctcaacaaacaac

SEQ ID NO: 23 - DNA, 25 bp, Artificial Sequence
  Primer
tttttagtggaagtagagtgggaag

SEQ ID NO: 24 - DNA, 25 bp, Artificial Sequence
  Primer
ttaaaacaacctccttacacaatcc

SEQ ID NO: 25 - DNA, 30 bp, Artificial Sequence
  Primer
gtttatttataggtttttttagatggtttg

SEQ ID NO: 26 - DNA, 29 bp, Artificial Sequence
  Primer
catcaaaactaactttatctcctaactca

SEQ ID NO: 27 - DNA, 30 bp, Artificial Sequence
  Primer
ggagattttttagtagagaataggtttttt

SEQ ID NO: 28 - DNA, 25 bp, Artificial Sequence
  Primer
tactacccaaaaccctactaatccc

SEQ ID NO: 29 - DNA, 28 bp, Artificial Sequence
  Primer
tttgttttatagtgggtagaatttattt

SEQ ID NO: 30 - DNA, 28 bp, Artificial Sequence
  Primer
aacctataaaaacattaacaaacaaaac

SEQ ID NO: 31 - DNA, 26 bp, Artificial Sequence
  Primer
gattttaaattttagtgaggggtgaa

SEQ ID NO: 32 - DNA, 25 bp, Artificial
  Primer
tccaaaacaaaaaataaactccaaa

SEQ ID NO: 33 - DNA, 28 bp, Artificial Sequence
  Primer
tttattttaatgagtaaagggtgtaggt

SEQ ID NO: 34 - DNA, 26 bp, Artificial Sequence
  Primer
cctaaaatcatacccaaacactaaat

SEQ ID NO: 35 - DNA, 25 bp, Artificial Sequence
  Primer
ggagggggtttattgattttagttt

SEQ ID NO: 36 - DNA, 25 bp, Artificial Sequence
  Primer
taactttctctacaccaaaccaacc

SEQ ID NO: 37 - DNA, 23 bp, Artificial Sequence
  Primer
ggtagtttttggttttgggtttt

SEQ ID NO: 38 - DNA, 25 bp, Artificial Sequence
  Primer
actatccctaaatctcatctctccc

SEQ ID NO: 39 - DNA, 24 bp, Artificial Sequence
  Primer
aatggagtgttttttttattggtt

SEQ ID NO: 40 - DNA, 21 bp, Artificial Sequence
  Primer
aatatcctaatcactcccttc

SEQ ID NO: 41 - DNA, 24 bp, Artificial Sequence
  Primer
gtatttttgtttaggtttttgggg

SEQ ID NO: 42 - DNA, 25 bp, Artificial Sequence
  Primer
aaaaatcataaatccctttccaatc

SEQ ID NO: 43 - DNA, 26 bp, Artificial Sequence
  Primer
tttttttaggaagtaaaaggaatgtt

SEQ ID NO: 44 - DNA, 26 bp, Artificial Sequence
  Primer
tcaaactaccctaatctcactatccc

SEQ ID NO: 45 - DNA, 25 bp, Artificial Sequence
  Primer
gatttttttaaaagtttttgtttgg

SEQ ID NO: 46 - DNA, 25 bp, Artificial Sequence
  Primer
acaaataccttcaattcactctcaa

SEQ ID NO: 47 - DNA, 20 bp, Artificial Sequence
  Primer
gtttttgattgggtaggggt

SEQ ID NO: 48 - DNA, 26 bp, Artificial Sequence
  Primer
aacttaccataaatcataaccaaacc

SEQ ID NO: 49 - DNA, 29 bp, Artificial Sequence
  Primer
gagttttgtgaaagtagataaaagaaaat

SEQ ID NO: 50 - DNA, 23 bp, Artificial Sequence
  Primer
taacacacaaaccaaaaaacatc

SEQ ID NO: 51 - DNA, 27 bp, Artificial Sequence
  Primer
tggttggtagtatttagatagtggttg

SEQ ID NO: 52 - DNA, 24 bp, Artificial Sequence
  Primer
atatacacaacaccccaaaaacaa

SEQ ID NO: 53 - DNA, 24 bp, Artificial Sequence
  Primer
aggttgttagagttggttgtggtt

SEQ ID NO: 54 - DNA, 26 bp, Artificial Sequence
  Primer
aactttctaaatctcaaatccctcaa

SEQ ID NO: 55 - DNA, 26 bp, Artificial Sequence
  Primer
gggaaggttattattattgttgtttt

SEQ ID NO: 56 - DNA, 22 bp, Artificial Sequence
  Primer
aaatcccaaaattctacaccca

SEQ ID NO: 57 - DNA, 24 bp, Artificial Sequence
  Primer
gttttttgttaggtttgaaagggg

SEQ ID NO: 58 - DNA, 27 bp, Artificial Sequence
  Primer
aaaaaaaatctaactccaaaactctaa

SEQ ID NO: 59 - DNA, 496 bp, Homo sapiens
tcccttaggtgggtgctggtagttcctgggagagttgacgggatggagcaggccaggggggctgagaagttggcctggcgagagaaggtgggtgggactgggagagcctgggcagggaggggcctttctgggagggagtgtcatggggctggccgagatccaggacccaggagactggccaagctgccacaggaggcctgagaggctgagcatgggggggccaacactgacagactttaacaagtttctggctcccccaggaaaaaaacagaccacatctgatccttggccctgagtccagagtgggaggcaccgtgacaacaatgcgcagagcagggaatgcagggagccatggatagtgctggggtgagctggagtcctggcaggggcccagctagggcagtactcattctgcagagcctgggagaaggggctgcctccttgggaggggtttgtgtgggagtctcagcgggaattctattggaccaggggaacc

SEQ ID NO: 60 - DNA, 385 bp, Homo sapiens
actggacaaaggtacagctgctaaaagaagtgctcgttcattggcttcgacagctgtacgactggtttctaattgctgttccagcctctccccagttccatataccacaaacgaatgaaaaagattagctctccctggagctctctgaggctgaaccttgctctctcattacacatggtaactaagcacaccccttaaagaattttgggaagtcgccccgcgattaccggctcccccaagaaccaagcagtcagtgcagggttttgcaagtgagagtgcgagactcgggaggctgctcacggtgctccagtccctggcaggagcatggacacctcgccccttccttccgtgggcctcaacgttgcctgctgagattgtgactgcc

SEQ ID NO: 61 - DNA, 474 bp, Homo sapiens
cccctagtggaagcagagtgggaagcaggtgggtggtggggtaggcggggcgggaagggaggcggaggagaaggtcccggcagacgaagcgagccccctggtggaagccagcagaaccaggtgcgtggcggcggaggcggggcggcccgctgggaaaccgaggaggggtcggattagttgaggggtggggtggggatgttctttggaatcaggatcactctttctttgggtgcttgtgtatgtccacaatttaaagaaagcaggaaacagggcaggggagttccttcatctagtaattccataataattgacgctagggaaactaggggagcagtgctctcacaggttttataaatgccagcatgtggtggaagattactcaacagttaataaagataatttcaagtggtggtaatgaagtagaaaataaaaacagtgtaatgtggtagggattgtgtaaggaggctgcctcaa

SEQ ID NO: 62 - DNA, 306 bp, Homo sapiens
gttcatccataggccctcccagatggtctgcgaggtgacaatgttgctgccgatgaaggccgtcacgcgccacatgggcagcgcgcagcacagcatgacggccagccagcccaggacggccagcgcgatgcccattacctgtagccccatggaggccattgttcagcgtccacgggagttgaggacctggaaggctgaggggatccggctgtgggggccgtaggattccaagcgctggggacggacttaacgttcgcagagtgcacctttgcaccgtgagtcaggagataaagccagtcctgatgc

SEQ ID NO: 63 - DNA, 303 bp, Homo sapiens
ggagattctccagtagagaacaggccctctaggttgcatatcaatagggagcatgtttaaggaatgttagccggtagtctttgctaggtgtgaggggtgaaatttttctttatcaaggctcaactgttttcgaagtcttcaggcttgaagttctggagaaaacaactaggctctccgggcgagatcccgaataccagtttaagggatttgaaatgcaaggccgtctgggactccactgccacggatgggcaccaggcggcgccggtcggatccgtcccgggactagcagggctttgggcagca

SEQ ID NO: 64 - DNA, 330 bp, Homo sapiens
tttgttttacagtgggcagaattcactttgctctaacttgactccaagatgacacaatttcccagttttttttttaacggctaggggatgggggtatgcggaacagaacacagtggtctagctaaccgatttccgctagacgtccagctatctttcaaaatattttgtttctgcacggcaacttcagccgctaaaaaagcatccagcttacaacggaacctggagggttggtaaaggccccctgcgctggccccgccccatgggaccgggcggcgtgggcgtgagaggcggggcggggccgcgctctgcttgccaatgtctttataggtc

SEQ ID NO: 65 - DNA, 417 bp, Homo sapiens
gactctaaatcctagtgaggggtgaatggggaggctagaacagccggcccttccctgcaggaagcccccattgggttggggtctgggaaaagggacagactggctgaggggggaagggcctggagccgggggtggtgggggcagcggggatgtcgggggtggcgggggtgggggaaattcctaaaataaggaaaccgtagccccgggggtcccgggtttccatataacaggcatctctgaagtgcctgtgctgtgcctggcgctgtgctagggagacacttccattcattcttcccactccagttaactgagcatctattaggctccagcccctatgctgggttctgaggatgcagcgacgcagaatagaagacaagagaatgttccttctctctggagcttaccttctgctttgga

SEQ ID NO: 66 - DNA, 368 bp, Homo sapiens
tccactccaatgagcaaagggtgtaggctttgagtatacacagcaggccacacactatgggtcatggcatacagtctagcgttggaggttgctgcatttgttcatgtatctatgagttaggttttaagttttttccccctgttctattaatataattaattagttaattaaccccactcattcatttactcagtccacagccttttgttaagagcccgcctaggacataaagatgaagatccagtgcctaccctcatgaaacatagaatccgagcgaagaaggcttactttgcaatagtcatccaagtggtgcttttatggcgctttactgctcccgccaacacccagtgcctgggtatgacctcagg

SEQ ID NO: 67 - DNA, 439 bp, Homo sapiens
ggagggggcttattgattccagccccgggcgctcgctcgggggcctacagaatggcgtgtttcggggttgtggcgggccgaggggcggggtcgcagcaaggccccgcctgtcccctcctgggcctctcaaagtctgagccccgctccgctgatgcctgtctgcagaatccgcaccaaccagcaccatgcccatgactctggggtactgggacatccgtggggtaagcgagggtcctctggtgggtgggacagggggcggaggcggggatgtgtggagtagctgcaggactggctctagggaccgttcctcttcagggctgcccgcctcagaagggcctgtgcatgacgctgtgtgtgtgtttgggggtgggggcgggtagaggaggcgacgggtacgtgcagtatagactaggggctggcctggtgcagagaaagtcac

SEQ ID NO: 68 - DNA, 395 bp, Homo sapiens
ggcagcccctggctttgggtcctgggtactagcaccccagttcattcccggtacccttcctgtcccagatgtcctggaatgagctgctccgggccccagggaggtgccctggacgccccttacccagggactcgctactgcccagaatgctctggaggccctgattcgggtgaggctgagggaagaggcgggagacacgaacgtagacgtagaagacatgcgatctggatggaacccaggacactccacttccggacctgaaggggaaatggagcctctagagtggcctgtggaagggtctggatttccctttaagtaaagacatacggagggacggagacccacaggacttgagggagggacggggagagggagagatgagactcagggacagc

SEQ ID NO: 69 - DNA, 255 bp, Homo sapiens
aatggagtgcccttcccattggcccgagcgtcattccccgaggtggcactgcccgcctgattggctggccactccagaccccccgcccactcctccactcgggtagccggactccccgccccccagcaccgcccggagcccccgccctcgcctctccctccgcgcccccgcccgcgcgcccagcgggctccgctcggctcgcgctgcgacccggcccgcgcgctggtcccgcccccggggcgcacggctctataa

SEQ ID NO: 70 - DNA, 391 bp, Homo sapiens
gcacctctgtctaggcctctgggggcgccccggccccgcccccgccgccctcggccaatcagacgtgcgtctcctcggccccggggcggagcgggccaggtgtgggaaatgaacagggctgggcgctagatacctgcgtggggtaggacccgcgaggaagaggtacgtgcggatcggtgggagagccaggcaccagacaggctcctgcactggagggttcggtccccgcctcttcatcagccaagctggggagatgcggcccttactgggacttggcaccgccctggtgggtgggttctatcagtttagaaccttggcctctgcctggcgcactgtggtcagggacgacttctccattccagcctggactggaaagggacccatgatctct

SEQ ID NO: 71 - DNA, 344 bp, Homo sapiens
cctccttaggaagtaaaaggaatgttagtgtgggattttgcattggaggctagtgctgaccccactgcagtggaacacagcactgggcagagcctccaaggcccttgattctaggctggaggccacagagggagcatttagacccccgccccgggtcagagggaaatctgctacctcagcaggaggaatccaagttccagtccacttcacaaccacctaactaaagtggccttccgccagaccctaaaacaaagatttgcattcaggtagattatttggaagatgatttaaggacgtaccagtgcaggagttgtcgcgggacagtgagaccagggcagtttgac

SEQ ID NO: 72 - DNA, 303 bp, Homo sapiens
gattcttctaaaagctcctgcctggactactttcctggctcctctctttgcccaagcccatccccccttacaggaataatagcatctgagggaagcgtcagttgtggctgcagcgccgagccctgccccagctcacctcgatgtcactccatacagactcagagtcctggttgcacatgtcccacgccatccagctcctgaatgacgccagtcaagctttttcaactccaatccacagtgacacagagcacacactcatgcaggcaaccagccccttactgagagtgaactgaaggcacctgt

SEQ ID NO: 73 - DNA, 228 bp, Homo sapiens
gtctttgactgggcaggggcttcggacggcggcggcggagaggctagagccatggacgaggagatcgtgtccgagaagcaagccgaggagagccaccggcaggacagcgccaacctgctcatcttcatcctgctgctcaccctcaccattctcacaatctggctcttcaagcaccgccgggcccgcttcctgcacgaaaccggcctggctatgatttatggcaagttc

SEQ ID NO: 74 - DNA, 243 bp, Homo sapiens
gagtcctgtgaaagcagataaaagaaaacatttattaacgtgtcattacgaggggagcgcccggccggggctgtcgcactccccgcggaacatttggctccctccagctccgagagaggagaagaagaaagcggaaaagaggcagattcacgtcgtttccagccaagtggacctgatcgatggccctcctgaatttatcacgatatttgatttattagcgatgccccctggtttgtgtgttac

SEQ ID NO: 75 - DNA, 328 bp, Homo sapiens
tggctggcagtacccagacagtggctggactcaagctcctcctccaggcttctaccgtcccccacggaccccctttctgtgctgcacttccgcctcctcggagccaaatcccacgcgtactggccgtcacgtgatgtaggacagcccaatcacgctcacccccttctcgttggcgccccagctccgccgcttggcctttcgggaagggtggaggaccagaagacggggactaggagcgctctgccgacgtcagcttttgtctccagtattttcgggggctggtggacgcgtgggcgatagggtgctgtccttggggtgctgtgtatat

SEQ ID NO: 76 - DNA, 406 bp, Homo sapiens
aggctgccagagctggctgtggccccacagagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgagacaataatctccactgatttttatcaaaggtgtttcctagacatggtcaagctacatggaaggatttgctgatagacagagacgacatgtggtgaggtcatcttggctgagggatctgagattcagaaagtc

SEQ ID NO: 77 - DNA, 394 bp, Homo sapiens
gggaaggccaccattactgctgttctacagaacgcggccctcttaaccctctccaccacctggctgtgtgggcgccgccgggagtgttcccccttccagatggggaaacggaggctccgagttagtcagctacccaaagttacacacagggagatctgatttgagccccagcagtccgactctagagaccctgtttttaattcctcttgcaggagactcgggggcccggccttctccccacctcagactacgctcccctacccctgtctcctgccacccctgggttgggtccgagtttggagcagggggctgctgagacgccaggcagcggcggggctgattgggggaagaggggaggagggcggtggcacgtgggtgcagaaccctgggatcc

SEQ ID NO: 78 - DNA, 362 bp, Homo sapiens
gtttcctgctaggcctgaaaggggcggggaaaccgtgccccggaactctgagcatgcgcagattcccgccgagcttgcgcagattcccgccgagctcgcgcagattccggccgagcatgcgcagattctctccgagcatgcgcagattcccgccgagcatgcgcagattcccgccgagcatgcgcacattctctccattccgccgtagtcgggagcgtgtggtgtttgagccgcctgaaacgctagtacgacagatttacttaaagattcacttaatcacttaaagattcacgtcccttttctctcattgagaataacacctaaggcattttgtgtcagagctctggagttagatttctttt

SEQ ID NO: 79 - DNA, 20 bp, Artificial Sequence
  Primer
tggcactaccctgaacatca

SEQ ID NO: 80 - DNA, 22 bp, Artificial Sequence
  Primer
catgaaatttctggttctgcat

SEQ ID NO: 81 - DNA, 1641 bp, Homo sapiens
tggcactaccctgaacatcaatgaaggctgtctgtttctggtcctgcttccgcagtgagaggcagcaggtccccaagcaggcgacctgcccttcaccgtgaggctgtcagccttgggggagcggggtcatttggagctgataaaccaatgagaagaaaggtttgttgctctaggcggtgggtgagggcatcatagctgactcttggtcttggtcactttcggaggagatggtttatttaacctgacttccttcctgatgcgcaccgtaggcgcagtgaaatccgggaatcgtggggaatccttggcgctgtgggtggaggctcctcttggccctgtggccaaggtgaccaagggccgaaggaaaagcgagaacgggagggacgggacgcaagagggcagatggggaaccccatactccagcaacattatataagagaggcgacgatggagcagcgcacccggccaaaaaagcctccgtgcgcctactctacggtgcaccgcgtcccctctgcaccagaagggccctgtcctcccacatccaccgcgccctcctccgggcccccgagggcactggggcgcttcctctgccagacctcccctgcgactcactcttccggctccagagcccccccgccccaacagcaaagcagccgtgacctgccccaggggcgcagccctgccccaggctggaaggcagcagagctgtggcgtcgaggcacccagcggactgcggggctggcgtgcccgcggttacctgcgcggccagagggctccgcgagatcgaagaaccagaagagcagcatgaggagccccgccgggcggcgaggggtcgcccagcctgtcctcatcctgagctggcgcaagccttccggccgggtcctcgggcgcacgcggctcccgccccgcctgctgagcgcggcctgccccgcccgcacctctgtctaggcctctgggggcgccccggccccgcccccgccgccctcggccaatcagacgtgcgtctcctcggccccggggcggagcgggccaggtgtgggaaatgaacagggctgggcgctagatacctgcgtggggtaggacccgcgaggaagaggtacgtgcggatcggtgggagagccaggcaccagacaggctcctgcactggagggttcggtccccgcctcttcatcagccaagctggggagatgcggcccttactgggacttggcaccgccctggtgggtgggttctatcagtttagaaccttggcctctgcctggcgcactgtggtcagggacgacttctccattccagcctggactggaaagggacccatgatctcttctaccccggaggaggaagtgagcacctgccctgtgggtggctgcggccaagcctaagaattcagtcgtccttggcaacgtcttgggtattttgacagtgcaaacaaaggtggaataatggtacactgcagttctacccatagttgttaaagaattaaaagcaagaattactagaatgaccaaacgacacttccaaggatgacttatgctttataaaaagttgacctttgcgagtaagctctttgcttaataatttaatgataataataattagctggtagaaatgtagaagtctgcatgcagaaccagaaatttcatg

SEQ ID NO: 82 - DNA, 20 bp, Artificial Sequence
  Primer
ctgtgacatggagcaggagc

SEQ ID NO: 83 - DNA, 21 bp, Artificial Sequence
  Primer
gctgtcgtttgccatcggcct

SEQ ID NO: 84 - DNA, 20 bp, Artificial Sequence
  Primer
catggccagtttcgatccat

SEQ ID NO: 85 - DNA, 20 bp, Artificial Sequence
  Primer
cacctgggactacacctcct

SEQ ID NO: 86 - DNA, 20 bp, Artificial Sequence
  Primer
tgctgacccagagctccata

SEQ ID NO: 87 - DNA, 20 bp, Artificial Sequence
  Primer
agaggcatcatcgcgatctg

SEQ ID NO: 88 - DNA, 19 bp, Artificial Sequence
  Primer
ggacatctaagggcatcac

SEQ ID NO: 89 - DNA, 20 bp, Artificial Sequence
  Primer
cctccgactttcgttcttga

SEQ ID NO: 90 - DNA, 20 bp, Artificial Sequence
  Primer
cacggtctgatgagctgtgt

SEQ ID NO: 91 - DNA, 20 bp, Artificial Sequence
  Primer
acgaactgcaacctgaccat

SEQ ID NO: 92 - DNA, 20 bp, Artificial Sequence
  Primer
ctggtcctcacgcagagttc

SEQ ID NO: 93 - DNA, 20 bp, Artificial Sequence
  Primer
gcgaagggcatcattgcaat

SEQ ID NO: 94 - DNA, 25 bp, Artificial Sequence
  Primer
gtgatgaaacgcacacctctcctga

SEQ ID NO: 95 - DNA, 25 bp, Artificial Sequence
  Primer
gtcatgaaaggcacacgtctgctca

SEQ ID NO: 96 - DNA, 25 bp, Artificial Sequence
  Primer
cattgttcagcatggtgaggtcgct

SEQ ID NO: 97 - DNA, 25 bp, Artificial Sequence
  Primer
cattcttcaccatcgtgacgtggct

SEQ ID NO: 98 - protein, 412 aa, Homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 99 - protein, 410 aa, Mus musculus
MGSSVYIMVELAIAVLAILGNVLVCWAVWINSNLQNVTNFFVVSLAAADIAVGVLAIPFAITISTGFCAACHGCLFFACFVLVLTQSSIFSLLAIAIDRYIAIRIPLRYNGLVTGMRAKGIIAICWVLSFAIGLTPMLGWNNCSQKDENSTKTCGEGRVTCLFEDVVPMNYMVYYNFFAFVLLPLLLMLAIYLRIFLAARRQLKQMESQPLPGERTRSTLQKEVHAAKSLAIIVGLFALCWLPLHIINCFTFFCSTCQHAPPWLMYLAIILSHSNSVVNPFIYAYRIREFRQTFRKIIRTHVLRRQEPFRAGGSSAWALAAHSTEGEQVSLRLNGHPLGVWANGSAPHSGRRPNGYTLGPGGGGSTQGSPGDVELLTQEHQEGQEHPGLGDHLAQGRVGTASWSSEFAPS

SEQ ID NO: 100 - protein, 442 aa, Danio rerio
MLNNVFDVLYMILELLIALLSVLGNVLVCWAVGLNSNLQSITNFFVVSLAVADIAVGVLAIPFSIVISTGFCANFYGCLFIACFVLVLTQSSIFSLLAIAIDRYIAIKIPLRYNSLVTGQRARGIIAICWVLSVIIGLTPMLGWHKARLQEGHNGTCPPGMMECLFEEVVVMDYMVYFNFFACVLVPLLLMLAIYLRIFMAARHQLKCIESKAIPCELKSRSTLQKEVHAAKSLAIIVGLFAVCWLPLHIINCFTLFCPECERPPALIMYLAIILSHANSVVNPFIYAYRIREFRHTFRKIVRYHILGRREPLSCNGSTRTSTRTSVADSLRIKVNGLVRELYAEQSSTTSSCESAEPGHTHRPVSTENSILDNQPIEISNSHRHTALRHPESPLTGNNEGLACRKHAGLDITDGKDLSSPLHIKSALYVQTAHCVELTEVS

SEQ ID NO: 101 - protein, 1873 aa, Homo sapiens
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLDCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 102 - protein, 1723 aa, Mus musculus
MRTGRVTPGLAAGLLLLLLRSFGLVEPSESSGNDPFTIVHENTGKCIQPLSDWVVAQDCSGTNNMLWKWVSQHRLFHLESQKCLGLDITKATDNLRMFSCDSTVMLWWKCEHHSLYTAAQYRLALKDGYAVANTNTSDVWKKGGSEENLCAQPYHEIYTRDGNSYGRPCEFPFLIGETWYHDCIHDEDHSGPWCATTLSYEYDQKWGICLLPESGCEGNWEKNEQIGSCYQFNNQEILSWKEAYVSCQNQGADLLSIHSAAELAYITGKEDIARLVWLGLNQLYSARGWEWSDFRPLKFLNWDPGTPVAPVIGGSSCARMDTESGLWQSVSCESQQPYVCKKPLNNTLELPDVWTYTDTHCHVGWLPNNGFCYLLANESSSWDAAHLKCKAFGADLISMHSLADVEVVVTKLHNGDVKKEIWTGLKNTNSPALFQWSDGTEVTLTYWNENEPSVPFNKTPNCVSYLGKLGQWKVQSCEKKLRYVCKKKGEITKDAESDKLCPPDEGWKRHGETCYKIYEKEAPFGTNCNLTITSRFEQEFLNYMMKNYDKSLRKYFWTGLRDPDSRGEYSWAVAQGVKQAVTFSNWNFLEPASPGGCVAMSTGKTLGKWEVKNCRSFRALSICKKVSEPQEPEEAAPKPDDPCPEGWHTFPSSLSCYKVFHIERIVRKRNWEEAERFCQALGAHLPSFSRREEIKDFVHLLKDQFSGQRWLWIGLNKRSPDLQGSWQWSDRTPVSAVMMEPEFQQDFDIRDCAAIKVLDVPWRRVWHLYEDKDYAYWKPFACDAKLEWVCQIPKGNTPQMPDWYNPERTGIHGPPVIIEGSEYWFVADPHLNYEEAVLYCASNHSFLATITSFTGLKAIKNKLANISGEEQKWWVKTSENPIDRYFLGSRRRLWHHFPMTFGDECLHMSAKTWLVDLSKRADCNAKLPFICERYNVSSLEKYSPDPAAKVQCTEKWIPFQNKCFLKVNSGPVTFSQASGICHSYGGTLPSVLSRGEQDFIISLLPEMEASLWIGLRWTAYERINRWTDNRELTYSNFHPLLVGRRLSIPTNFFDDESHFHCALILNLKKSPLTGTWNFTSCSERHSLSLCQKYSETEDGQPWENTSKTVKYLNNLYKIISKPLTWHGALKECMKEKMRLVSITDPYQQAFLAVQATLRNSSFWIGLSSQDDELNFGWSDGKRLQFSNWAGSNEQLDDCVILDTDGFWKTADCDDNQPGAICYYPGNETEEEVRALDTAKCPSPVQSTPWIPFQNSCYNFMITNNRHKTVTPEEVQSTCEKLHSKAHSLSIRNEEENTFVVEQLLYFNYIASWVMLGITYENNSLMWFDKTALSYTHWRTGRPTVKNGKFLAGLSTDGFWDIQSFNVIEETLHFYQHSISACKIEMVDYEDKHNGTLPQFIPYKDGVYSVIQKKVTWYEALNACSQSGGELASVHNPNGKLFLEDIVNRDGFPLWVGLSSHDGSESSFEWSDGRAFDYVPWQSLQSPGDCVVLYPKGIWRREKCLSVKDGAICYKPTKDKKLIFHVKSSKCPVAKRDGPQWVQYGGHCYASDQVLHSFSEAKQVCQELDHSATVVTIADENENKFVSRLMRENYNITMRVWLGLSQHSLDQSWSWLDGLDVTFVKWENKTKDGDGKCSILIASNETWRKVHCSRGYARAVCKIPLSPDYTGIAILFAVLCLLGLISLAIWFLLQRSHIRWTGFSSVRYEHGTNEDEVMLPSFHD

SEQ ID NO: 103 - protein, 1726 aa, Danio rerio
MYWSTQLLFSSIIFLLSGGHLGSCASAANSGDDTFKIQHSTDGKCLLVQNGALKLGNCSSVPAVLWKWGSAHRLFHMESSMCLGLEVRTKTVTLFSCDSTEILRWKCYEDVIYTEYQMKLSVGAGESVIAKRDGQDTWKREGSTDNICQRTYRKMHTSGGNSKGAPCEFPFLYNGTWHHSCLPPTDENTLEWCSTTANYDQEQKWGNCLKYVEGCSSLWEKEPVTGRCYQVVSTAVVTWHEARDACRSQGGDLLSLSSPQELQFFKDRKDLPSKLWIGVNHLDWMQGWQWSDGSPLSFAPWETGIPIRSLLSDEDCGVLKESLRFGAETCENRLPFICMKNENDTESTVRDVYKPTNCSDGWIGWKGYCYKLHSAESKMSQHEALDLCKMDDAKLASLHSLDDIEMLHTNFHGDLKTEVWIGLWGNGSTSVFEWVDKAPVSFTYWARAQPPPLLPNTINCVYYSGEHHTWSVSDCDKPRAYMCMRNSQNVNESAAEEGCPPDGNWKRHGDACYTVDTNLVFYKNSCHISINNRFEQAFINSLLKEHISTEVLYFWTGLQDSKGSGEYQWFSQDETADQVTYTNWKWLEPASAGGCVVMSSGNPLGRWAVKNCTSFKAGNICKKPIKSKVQPIPDPFVPNPNASCAPGWVSREGLNYCYKVFHEERLTRKRSWEEAERFCEALGGHLPSFTEVKDMEALHLILRNSVSNNRFFWVGLNRRNPNTNNNWEWSDGRPVSMMIFPEEFKEDDDYNRDCIAFKTMKPTYKPFLFLLIHKASPRPFYPSTFHCDAKLEWVCQIPRGQTPKTPEWYNPDGHHNTSAFIDGQEFWFVTEPKLSYEEAVLYCSSNNSKLASPDTLKAALHLQEQISEHSGPHFIRWWADLRYPGPHVPFMFSHMRYYESSFRGPCPSITPVSLDPGYSRICNEKQPFVCETLNVTSVEKGTPEPHPVGTQCGGNTYHFKNKCYQILSESYFQNFKEANEFCQQLKGSLLTISDQVEQDFITTLLPKLPNQPRKVWIGLKFKRPDTQWVDNSPIEYLNFNPLLHGQFRSIFINPFEHDQLELCAYMYNDDHSDMMGTWDYTSCTDRQFNSICQYFADKLEEPKPENNFTVQNHTFKVVQQDNLTWADALQLCRSFNLELASVPNAYVQAVLTTQVSRRGKPLWIGLFSEDDGEHYKWTDNSHSEFNRWTSEATEGSCVFLDTDGFWKATDCEEELSGAICHIPSIDKTITPDKPCHHKSNGQSWIRFKKNCYTLLLMSSRWGNGDISDHKICSTLDKHGEILTIRDEAENNFIMQQLKPFKDLAMFVWLGMSTNKTDEQLKWLDGTYVQFSNWKYGERPNMTNSFIAGLNLNGEWETISKQHLDVFKQQSIVVCKIENDTKDEFLKGVVDINTPQDISYRRVAKKLNWYQALQECGSNGGHLASITDKTTNENMALIAKRDGFSLWIGLSKQDVSRWPFEWSDGTAVKFKTDGFEDDGDDSEEKCVFIDSTGNWSAVNCHATQQGAICYNHLNEGTSDRFSKSSSSCPKSDGQSSWVLFKDHCYNFNTYNFSVFTMDDAKNVCQTLDSSSNLLTIKSKEENDFVSDYINKNPSITSRVWLALIVDAKGNPTGWQDGSELDFSSWDLSNSKAQHSLDGTQLCAVMLSSSGSWTQASCSNSRSRVVCKAPAHPGTPVALIFFIIIVLILAAAVGFILYQKNKHRFHSPVRYQRNFDDADSTSMINDAD

The invention claimed is:

1. A method for analyzing LY75 gene methylation in a sample from a patient, the method comprising:

determining a DNA methylation level of a target genomic sequence in genomic DNA obtained from a patient sample and a control sample from a subject not having DCM or having a normal heart function, the patient sample and the control sample comprising heart cells or heart tissue, wherein said determining the DNA methylation level of the target genomic sequence comprises the steps of:

i) isolating the genomic DNA from the patient sample and the control sample, ii) bisulfite treating the genomic DNA from the patient sample and the control sample;

iii) PCR amplifying the target genomic sequence from the bisulfite treated genomic DNA from the patient sample and the control sample using a primer pair having the sequence of SEQ ID NOs. 41 and 42;

iv) determining the DNA methylation level of the target genomics sequences in the patient sample and the control sample; and v) comparing the level of DNA methylation in the target genomic sequence in the patient sample to the level of DNA methylation in the target genomic sequence of the control sample.

2. The method according to claim 1, wherein the DNA methylation of the patient sample has a different degree of CpG methylation compared to the DNA methylation of the control sample.

3. The method according to claim 1, wherein the DNA methylation level of the target genomic sequence in the patient sample is determined before and after a therapy is provided to the patient and the DNA methylation level of the target genomic sequence in the patient sample before and after the therapy is used for determining the effects of the therapy provided to the patient.

4. The method according to claim 1, wherein the patient sample is a sample of left ventricular tissue.

5. The method according to claim 1, further comprising providing a prognosis of DCM or heart failure comprises risk stratification and/or disease classification.

6. The method according to claim 1, the method further comprising determining the methylation level of at least one of SEQ ID NOs. 1-2 and 4-18 in a patient sample and the control sample.

7. The method according to claim 6, wherein the patient sample is a sample of left ventricular tissue.

8. The method according to claim 3, wherein the therapy monitoring comprises treatment monitoring, treatment decision making, and the prediction of therapy effects or method.

9. A method for amplifying a target genomic sequence in genomic DNA obtained from a patient sample, and, optionally a control samples, the patient sample and the control sample compromising heart cells or heart tissue, wherein said amplifying the target genomic sequence comprises i) isolating genomic DNA from the patient sample and, optionally, the control sample ii) bisulfite treating the isolated genomic DNA, and iii) PCR amplifying the bisulfite treated genomic DNA with a primer pair having the sequences of SEQ ID NOs. 41 and 42.

10. The method of claim 1, wherein the step v) comprises comparing the mean CpG methylation level of the target genomic sequence in the patient sample with the mean CpG methylation level of the target genomic sequence in the control sample.

11. A method of amplifying a target genomic sequence in genomic DNA of a human cell, the method comprising the steps of:

i) isolating the genomic DNA from the human cell, ii) bisulfite treating the isolated genomic DNA, and iii) PCR amplifying the bisulfite treated genomic DNA with a primer pair having the sequences of SEQ ID NOs. 41 and 42.

12. The method according to claim 1, the method further comprising providing an indication of the presence or absence of dilated cardiomyopathy (DCM) or heart failure in the patient.

* * * * *

UNITED STATES PATENT AND TRADEMARK OFFICE
CERTIFICATE OF CORRECTION

PATENT NO. : 9,938,580 B2
APPLICATION NO. : 14/384955
DATED : April 10, 2018
INVENTOR(S) : Benjamin Meder et al.

It is certified that error appears in the above-identified patent and that said Letters Patent is hereby corrected as shown below:

Column 32,
Lines 1-2, In Claim 8 "wherein the therapy monitoring comprises" should read -- where the method comprises --.
Line 3, In Claim 8 "therapy effects or method." should read -- therapy effects or therapy outcome. --.

Signed and Sealed this
Ninth Day of April, 2019

Andrei Iancu
*Director of the United States Patent and Trademark Office*